US010407724B2

(12) United States Patent
Hatchwell et al.

(10) Patent No.: US 10,407,724 B2
(45) Date of Patent: Sep. 10, 2019

(54) METHODS AND COMPOSITIONS FOR SCREENING AND TREATING DEVELOPMENTAL DISORDERS

(71) Applicants: Population Diagnostics, Inc., Melville, NY (US); The Hospital for Sick Children, Toronto (CA)

(72) Inventors: Eli Hatchwell, Winchester (GB); Peggy S. Eis, Fitchburg, WI (US); Stephen Scherer, Toronto (CA); Aparna Prasad, Rochester, NY (US)

(73) Assignees: THE HOSPITAL FOR SICK CHILDREN, Toronto, Ontario; POPULATION BIO, INC., Melville, NY (US)

( * ) Notice: Subject to any disclaimer, the term of this patent is extended or adjusted under 35 U.S.C. 154(b) by 269 days.

(21) Appl. No.: 13/763,550

(22) Filed: Feb. 8, 2013

(65) Prior Publication Data

US 2014/0161721 A1    Jun. 12, 2014

Related U.S. Application Data

(60) Provisional application No. 61/633,323, filed on Feb. 9, 2012.

(51) Int. Cl.
*C12Q 1/68* (2018.01)
*C12Q 1/6883* (2018.01)
*C12N 15/11* (2006.01)
*G01N 33/68* (2006.01)

(52) U.S. Cl.
CPC .......... *C12Q 1/6883* (2013.01); *C12N 15/111* (2013.01); *G01N 33/6845* (2013.01); *C12N 2310/141* (2013.01); *C12N 2320/10* (2013.01); *C12Q 2600/156* (2013.01); *G01N 2800/38* (2013.01)

(58) Field of Classification Search
None
See application file for complete search history.

(56) References Cited

U.S. PATENT DOCUMENTS

| | | | |
|---|---|---|---|
| 3,625,214 A | 12/1971 | Higuchi et al. |
| 4,683,195 A | 7/1987 | Mullis et al. |
| 4,789,734 A | 12/1988 | Pierschbacher |
| 4,897,268 A | 1/1990 | Tice et al. |
| 4,906,474 A | 3/1990 | Langer et al. |
| 4,925,673 A | 5/1990 | Steiner et al. |
| 4,992,445 A | 2/1991 | Lawter et al. |
| 5,001,139 A | 3/1991 | Lawter et al. |
| 5,023,252 A | 6/1991 | Hseih |
| 5,075,109 A | 12/1991 | Tice et al. |
| 5,143,854 A | 9/1992 | Pirrung et al. |
| 5,190,029 A | 3/1993 | Byron et al. |
| 5,223,409 A | 6/1993 | Ladner et al. |
| 5,272,071 A | 12/1993 | Chappel |
| 5,288,514 A | 2/1994 | Ellman |
| 5,376,359 A | 12/1994 | Johnson |
| 5,384,261 A | 1/1995 | Winkler et al. |
| 5,424,186 A | 6/1995 | Fodor et al. |
| 5,445,934 A | 8/1995 | Fodor et al. |
| 5,451,683 A | 9/1995 | Barrett et al. |
| 5,510,270 A | 4/1996 | Fodor et al. |
| 5,527,681 A | 6/1996 | Holmes et al. |
| 5,665,549 A | 9/1997 | Pinkel et al. |
| 5,700,637 A | 12/1997 | Southern |
| 5,744,305 A | 4/1998 | Fodor et al. |
| 5,776,434 A | 7/1998 | Purewal et al. |
| 5,811,128 A | 9/1998 | Tice et al. |
| 5,814,344 A | 9/1998 | Tice et al. |
| 5,820,883 A | 10/1998 | Tice et al. |
| 5,837,832 A | 11/1998 | Chee et al. |
| 5,853,763 A | 12/1998 | Tice et al. |
| 5,858,659 A | 1/1999 | Sapolsky et al. |
| 5,928,647 A | 7/1999 | Rock |
| 5,942,252 A | 8/1999 | Tice et al. |
| 5,945,334 A | 8/1999 | Besemer et al. |
| 6,040,138 A | 3/2000 | Lockhart et al. |
| 6,054,270 A | 4/2000 | Southern |
| 6,146,834 A | 11/2000 | Schaad et al. |
| 6,207,392 B1 | 3/2001 | Weiss et al. |
| 6,210,878 B1 | 4/2001 | Pinkel et al. |
| 6,251,607 B1 | 6/2001 | Tsen et al. |
| 6,300,063 B1 | 10/2001 | Lipshutz et al. |
| 6,423,499 B1 | 7/2002 | Song et al. |
| 6,429,027 B1 | 8/2002 | Chee et al. |

(Continued)

FOREIGN PATENT DOCUMENTS

| | | |
|---|---|---|
| CN | 1733937 A | 2/2006 |
| CN | 101148684 A | 3/2008 |

(Continued)

OTHER PUBLICATIONS

GeneCards output for DIAPH2 gene, from www.genecards.ord, pritned on Jun. 11, 2015, pp. 1-11.*
Human Genome CGH Microarrays—Details & Specifications, six printed pages from www.agilent.com, printed on May 20, 2015.*
McInnes et al. Molecular Autism 2010, 1:5, pp. 1-12.*
Lucentini, J. The Scientist, Dec. 20, 2004, p. 20.*

(Continued)

*Primary Examiner* — Juliet C Switzer

(74) *Attorney, Agent, or Firm* — Wilson Sonsini Goodrich & Rosati

(57) ABSTRACT

This document provides methods and materials related to genetic variations of developmental disorders. For example, this document provides methods for using such genetic variations to assess susceptibility of developing Autism Spectrum Disorder.

15 Claims, 2 Drawing Sheets

Specification includes a Sequence Listing.

(56) References Cited

U.S. PATENT DOCUMENTS

| | | |
|---|---|---|
| 6,733,977 B2 | 5/2004 | Besemer et al. |
| 6,858,394 B1 | 2/2005 | Chee et al. |
| 6,858,412 B2 | 2/2005 | Willis et al. |
| 6,892,141 B1 | 5/2005 | Nakae et al. |
| 6,916,621 B2 | 7/2005 | Shah |
| 6,951,761 B2 | 10/2005 | Star et al. |
| 6,969,589 B2 | 11/2005 | Patil et al. |
| 6,977,148 B2 | 12/2005 | Dean et al. |
| 7,011,949 B2 | 3/2006 | Amorese et al. |
| 7,014,997 B2 | 3/2006 | Knoll et al. |
| 7,030,231 B1 | 4/2006 | Craik et al. |
| 7,034,144 B2 | 4/2006 | Van Dongen et al. |
| 7,364,858 B2 | 4/2008 | Barany et al. |
| 7,424,368 B2 | 9/2008 | Huang et al. |
| 7,702,468 B2 | 4/2010 | Chinitz et al. |
| 7,957,913 B2 | 6/2011 | Chinitz et al. |
| 7,998,744 B2 | 8/2011 | Stevenson et al. |
| 8,367,417 B2 | 2/2013 | Stevenson et al. |
| 8,655,599 B2 | 2/2014 | Chinitz et al. |
| 8,862,410 B2 | 10/2014 | Hatchwell et al. |
| 9,976,180 B2 | 5/2018 | Hatchwell et al. |
| 10,059,997 B2 | 8/2018 | Hatchwell et al. |
| 2002/0012921 A1 | 1/2002 | Vincent, Jr. |
| 2002/0012930 A1 | 1/2002 | Rothberg et al. |
| 2003/0023070 A1 | 1/2003 | Ni et al. |
| 2003/0049663 A1 | 3/2003 | Wigler et al. |
| 2003/0068629 A1 | 4/2003 | Rothberg et al. |
| 2003/0082606 A1 | 5/2003 | Lebo et al. |
| 2003/0100102 A1 | 5/2003 | Rothberg et al. |
| 2003/0148344 A1 | 8/2003 | Rothberg et al. |
| 2003/0207295 A1 | 11/2003 | Gunderson et al. |
| 2003/0215821 A1 | 11/2003 | Gunderson et al. |
| 2004/0018491 A1 | 1/2004 | Gunderson et al. |
| 2004/0137473 A1 | 7/2004 | Wigler et al. |
| 2004/0157243 A1 | 8/2004 | Huang et al. |
| 2004/0197774 A1 | 10/2004 | Wigler et al. |
| 2004/0248161 A1 | 12/2004 | Rothberg et al. |
| 2005/0032095 A1 | 2/2005 | Wigler et al. |
| 2005/0037393 A1 | 2/2005 | Gunderson et al. |
| 2005/0037414 A1 | 2/2005 | Lee et al. |
| 2005/0079510 A1 | 4/2005 | Berka et al. |
| 2005/0100893 A1 | 5/2005 | Gunderson et al. |
| 2005/0100932 A1 | 5/2005 | Lapidus et al. |
| 2005/0112595 A1 | 5/2005 | Zhao et al. |
| 2005/0124022 A1 | 6/2005 | Srinivasan et al. |
| 2005/0196799 A1 | 9/2005 | Wigler et al. |
| 2005/0233339 A1 | 10/2005 | Barrett et al. |
| 2005/0266444 A1 | 12/2005 | Wigler et al. |
| 2005/0282196 A1 | 12/2005 | Costa |
| 2006/0012784 A1 | 1/2006 | Ulmer |
| 2006/0012793 A1 | 1/2006 | Harris |
| 2006/0024678 A1 | 2/2006 | Buzby |
| 2006/0024711 A1 | 2/2006 | Lapidus et al. |
| 2006/0063168 A1 | 3/2006 | Albertson et al. |
| 2006/0078909 A1 | 4/2006 | Srinivasan et al. |
| 2006/0134674 A1 | 6/2006 | Huang et al. |
| 2007/0141577 A1 | 6/2007 | Moore |
| 2007/0207481 A1 | 9/2007 | Wigler et al. |
| 2007/0259351 A1 | 11/2007 | Chinitz et al. |
| 2008/0131887 A1 | 6/2008 | Stephan et al. |
| 2009/0026082 A1 | 1/2009 | Rothberg et al. |
| 2009/0098547 A1 | 4/2009 | Ghosh |
| 2009/0127589 A1 | 5/2009 | Rothberg et al. |
| 2009/0170712 A1 | 7/2009 | Beatty et al. |
| 2009/0304653 A1 | 12/2009 | Messier |
| 2010/0003685 A1 | 1/2010 | Aasly et al. |
| 2010/0028931 A1 | 2/2010 | Eggan et al. |
| 2010/0035252 A1 | 2/2010 | Rothberg et al. |
| 2010/0120046 A1 | 5/2010 | Brennan et al. |
| 2010/0137143 A1 | 6/2010 | Rothberg et al. |
| 2010/0167286 A1 | 7/2010 | Reijo Pera et al. |
| 2010/0188073 A1 | 7/2010 | Rothberg et al. |
| 2010/0197507 A1 | 8/2010 | Rothberg et al. |
| 2010/0227768 A1 | 9/2010 | Wigler et al. |
| 2010/0248236 A1 | 9/2010 | Chinitz et al. |
| 2011/0021366 A1 | 1/2011 | Chinitz et al. |
| 2011/0111014 A1 | 5/2011 | Langston |
| 2011/0111419 A1 | 5/2011 | Stefansson et al. |
| 2011/0130337 A1 | 6/2011 | Eriksson et al. |
| 2011/0264376 A1 | 10/2011 | Chinitz et al. |
| 2011/0311512 A1 | 12/2011 | Hakonarson et al. |
| 2012/0046877 A1 | 2/2012 | Hyland et al. |
| 2012/0059594 A1 | 3/2012 | Hatchwell et al. |
| 2012/0100995 A1 | 4/2012 | Scherer et al. |
| 2013/0247249 A1 | 9/2013 | Singh et al. |
| 2013/0305410 A1 | 11/2013 | Bent et al. |
| 2013/0316911 A1 | 11/2013 | Scherer |
| 2014/0088882 A1 | 3/2014 | Chinitz et al. |
| 2014/0155271 A1 | 6/2014 | Hatchwell et al. |
| 2014/0162894 A1 | 6/2014 | Hatchwell et al. |
| 2014/0162933 A1 | 6/2014 | Hatchwell et al. |
| 2014/0208449 A1 | 7/2014 | Malek |
| 2015/0051086 A1 | 2/2015 | Hatchwell et al. |
| 2016/0019336 A1 | 1/2016 | Chinitz et al. |

FOREIGN PATENT DOCUMENTS

| | | |
|---|---|---|
| CN | 101403008 A | 4/2009 |
| EP | 0373203 B1 | 8/1994 |
| EP | 0619321 A1 | 10/1994 |
| KR | 2009-0080105 A | 7/2009 |
| KR | 2011-0114664 A | 10/2011 |
| WO | WO 90/02809 A1 | 3/1990 |
| WO | WO 91/06667 A1 | 5/1991 |
| WO | WO 91/17271 A1 | 11/1991 |
| WO | WO 92/01047 A1 | 1/1992 |
| WO | WO 92/09690 A2 | 6/1992 |
| WO | WO 92/10092 A1 | 6/1992 |
| WO | WO 92/15679 A1 | 9/1992 |
| WO | WO 92/18619 A1 | 10/1992 |
| WO | WO 92/20791 A1 | 11/1992 |
| WO | WO 92/09690 A3 | 12/1992 |
| WO | WO 93/01288 A1 | 1/1993 |
| WO | WO 93/22684 A1 | 11/1993 |
| WO | WO 95/11995 A1 | 5/1995 |
| WO | WO 98/20019 A1 | 5/1998 |
| WO | WO 02/099129 A2 | 12/2002 |
| WO | WO 03/048318 A2 | 6/2003 |
| WO | WO 2004/018633 A2 | 3/2004 |
| WO | WO 2004/044225 A2 | 5/2004 |
| WO | WO 2004/075010 A2 | 9/2004 |
| WO | WO 2005/042763 A2 | 5/2005 |
| WO | WO 2005/068664 A2 | 7/2005 |
| WO | WO 2005/108997 A1 | 11/2005 |
| WO | WO 2004/044225 A3 | 4/2006 |
| WO | WO 2006/050475 A2 | 5/2006 |
| WO | WO 2007/070640 A2 | 6/2007 |
| WO | WO 2007/070640 A3 | 8/2007 |
| WO | WO 2007/129000 A2 | 11/2007 |
| WO | WO 2007/131135 A2 | 11/2007 |
| WO | WO 2008/016374 A2 | 2/2008 |
| WO | WO 2007/129000 A3 | 3/2008 |
| WO | WO 2007/131135 A3 | 11/2008 |
| WO | WO 2009/043178 A1 | 4/2009 |
| WO | WO 2009/073764 A1 | 6/2009 |
| WO | WO 2010/036353 A2 | 4/2010 |
| WO | WO 2010/056897 A1 | 5/2010 |
| WO | WO 2011/012672 A1 | 2/2011 |
| WO | WO 2011/035012 A2 | 3/2011 |
| WO | WO 2011/112961 A1 | 9/2011 |
| WO | WO 2012/023519 A2 | 3/2012 |
| WO | WO 2012/027491 A1 | 3/2012 |
| WO | WO 2012/047234 A1 | 4/2012 |
| WO | WO 2013/071119 A2 | 5/2013 |
| WO | WO-2013067451 A2 | 5/2013 |
| WO | WO 2014/043519 A1 | 3/2014 |

OTHER PUBLICATIONS

Juppner H, Bone vol. 17, No. 2, Supplement, Aug. 1995:39S-42S.*
Pennisi E. Science; Sep. 18, 1998; 281, 5384, pp. 1787-1789.*
Pinto et al. (Nature, vol. 466, Jul. 15, 2010, pp. 368-372, plus pp. 1-73 of supplementary information; 78 pages combined).*
Hegele Arterioscler Thromb Vasc Biol 2002;22;1058-1061.*

(56) References Cited

OTHER PUBLICATIONS

Xie et al. (BMC Bioinformatics 2009, published Mar. 6, 2009, nine pages).*
Sanders et al. Neuron. Jun. 9, 2011;70(5):863-85. doi: 10.1016/j.neuron.2011.05.002, 11 pages including supplemental table (Year: 2011).*
Kaminsky et al. Genet Med. Sep. 2011;13(9):777-84. doi: 10.1097/GIM.0b013e31822c79f9., 26 pages including supplemental table (Year: 2011).*
Betancur, et al. The emerging role of synaptic cell-adhesion pathways in the pathogenesis of autism spectrum disorders. Trends Neurosci. Jul. 2009;32(7):402-12. doi: 10.1016/j.tins.2009.04.003. Epub Jun. 21, 2009.
Office action dated Dec. 16, 2014 for U.S. Appl. No. 12/449,566.
U.S. Appl. No. 14/090,932, filed Nov. 26, 2013, Chinitz et al.
De Krom, et al. A common variant in DRD3 receptor is associated with autism spectrum disorder. Biol Psychiatry. Apr. 1, 2009;65(7):625-30. doi: 10.1016/j.biopsych.2008.09.035. Epub Dec. 5, 2008.
International search report and written opinion dated Jan. 15, 2014 for PCT/US2013/062346.
Knight, et al. A cytogenetic abnormality and rare coding variants identify ABCA13 as a candidate gene in schizophrenia, bipolar disorder, and depression. Am J Hum Genet. Dec. 2009;85(6):833-46. doi: 10.1016/j.ajhg.2009.11.003.
NCBI GenBank accession No. NG_12385.1. Mar. 27, 2012.
Bremer, et al. Copy number variation characteristics in subpopulations of patients with autism spectrum disorders. Am J Med Genet B Neuropsychiatr Genet. Mar. 2011;156(2):115-24. doi: 10.1002/ajmg.b.31142. Epub Dec. 8, 2010.
European search report and opinion dated Feb. 11, 2015 for EP Application No. 12839712.2.
Griswold, et al. A de novo 1.5 Mb microdeletion on chromosome 14q23.2-23.3 in a patient with autism and spherocytosis. Autism Res. Jun. 2011;4(3):221-7. doi: 10.1002/aur.186. Epub Feb. 28, 2011.
Marshall, et al. Structural variation of chromosomes in autism spectrum disorder. Am J Hum Genet. Feb. 2008;82(2):477-88. doi: 10.1016/j.ajhg.2007.12.009. Epub Jan. 17, 2008.
Pinto, et al. Comprehensive assessment of array-based platforms and calling algorithms for detection of copy number variants. Nat Biotechnol. May 8, 2011;29(6):512-20. doi: 10.1038/nbt.1852.
Sudhof. Neuroligins and neurexins link synaptic function to cognitive disease. Nature. Oct. 16, 2008;455(7215):903-11. doi: 10.1038/nature07456.
U.S. Appl. No. 13/648,874, filed Oct. 10, 2012, Scherer.
Agami, R. RNAi and related mechanisms and their potential use for therapy. Curr Opin Chem Biol. Dec. 2002;6(6):829-34.
Aitman, et al. Copy number polymorphism in Fcgr3 predisposes to glomerulonephritis in rats and humans. Nature. Feb. 16, 2006;439(7078):851-5.
Albertson, et al. Profiling breast cancer by array CGH. Breast Cancer Res Treat. Apr. 2003;78(3):289-98.
Altschul, et al. Gapped BLAST and PSI-BLAST: a new generation of protein database search programs. Nucleic Acids Res. Sep. 1, 1997;25(17):3389-402.
Amarzguioui, et al. Approaches for chemically synthesized siRNA and vector-mediated RNAi. FEBS Lett. Oct. 31, 2005;579(26):5974-81. Epub Sep. 20, 2005.
Ansel et al., Pharmaceutical Dosage Forms and Drug Delivery Systems (Lippencott Williams & Wilkins, Baltimore Md. (1999).
Arakawa, et al. Advances in characterization of neuroprotective peptide, humanin. Curr Med Chem. 2011;18(36):5554-63.
Ausubel (Ed.), Current Protocols in Molecular Biology (2007 John Wiley & Sons, NY).
Bailey, et al. Analysis of Segmental Duplications and Genome Assembly in the Mouse. Genome Res. 2004; 14:789-801.
Bakkaloglu, et al. Molecular cytogenetic analysis and resequencing of contactin associated protein-like 2 in autism spectrum disorders. Am J Hum Genet. Jan. 2008;82(1):165-73.
Bangham, et al. Diffusion of univalent ions across the lamellae of swollen phospholipids. J Mol Biol. Aug. 1965;13(1):238-52.
Bedell, et al. In vivo genome editing using a high-efficiency TALEN system. Nature. Sep. 23, 2012. doi: 10.1038/nature11537. [Epub ahead of print].
Bennett, C. Efficiency of antisense oligonucleotide drug discovery. Antisense Nucleic Acid Drug Dev. Jun. 2002;12(3):215-24.
Berkel, et al. Mutations in the SHANK2 synaptic scaffolding gene in autism spectrum disorder and mental retardation. Nat Genet. Jun. 2010;42(6):489-91. Epub May 16, 2010.
Bernstein, et al. Role for a bidentate ribonuclease in the initiation step of RNA interference. Nature. Jan. 18, 2001;409(6818):363-6.
Bier, et al. DNA microarrays. Adv Biochem Eng Biotechnol. 2008;109:433-53.
Biomarkers Definitions Working Group. Biomarkers and surrogate endpoints: preferred definitions and conceptual framework. Clin Pharmacol Ther. Mar. 2001;69(3):89-95.
Bochukova, et al. Large, rare chromosomal deletions associated with severe early-onset obesity. Nature. Feb. 4, 2010;463(7281):666-70. Epub Dec. 6, 2009.
Bodmer, et al. Common and rare variants in multifactorial susceptibility to common diseases. Nat Genet. Jun. 2008;40(6):695-701.
Bodzioch, et al. Evidence for potential functionality of nuclearly-encoded humanin isoforms. Genomics. Oct. 2009;94(4):247-56. Epub May 27, 2009.
Bosher, et al. RNA interference: genetic wand and genetic watchdog. Nat Cell Biol. Feb. 2000;2(2):E31-6.
Brummelkamp, et al. A system for stable expression of short interfering RNAs in mammalian cells. Science. Apr. 19, 2002;296(5567):550-3. Epub Mar. 21, 2002.
Chavanpatil, et al. Novel sustained release, swellable and bioadhesive gastroretentive drug delivery system for ofloxacin. Int J Pharm. Jun. 19, 2006;316(1-2):86-92. Epub Mar. 29, 2006.
Chen, et al. The evolution of gene regulation by transcription factors and microRNAs. Nat Rev Genet. Feb. 2007;8(2):93-103.
Chen, H. Clinical development of antisense oligonucleotides as anti-cancer therapeutics. Methods Mol Med. 2003;75:621-36.
Chi, et al. Genomewide view of gene silencing by small interfering RNAs. Proc Natl Acad Sci U S A. May 27, 2003;100(11):6343-6. Epub May 2, 2003.
Conrad, et al. Origins and functional impact of copy number variation in the human genome. Nature. Apr. 1, 2010;464(7289):704-12. Epub Oct. 7, 2009.
Cronin, et al. Analysis of genome-wide copy number variation in Irish and Dutch ALS populations. Hum Mol Genet. Nov. 1, 2008;17(21):3392-8. Epub Aug. 7, 2008.
Culture of Animal Cells: A Manual of Basic Technique by R. Ian Freshney, Publisher: Wiley-Liss; 5th edition (2005).
Dias, et al. Antisense oligonucleotides: basic concepts and mechanisms. Mol Cancer Ther. Mar. 2002;1(5):347-55.
Dibbens, et al. Familial and sporadic 15q13.3 microdeletions in Idiopathic Generalized Epilepsy: Precedent for Disorders with Complex Inheritance. Hum Mol Genet. Jul. 10, 2009. [Epub ahead of print].
Elbashir, et al. RNA interference is mediated by 21- and 22-nucleotide RNAs. Genes Dev. Jan. 15, 2001;15(2):188-200.
ENCODE project consortium, et al. An integrated encyclopedia of DNA elements in the human genome. Nature. Sep. 6, 2012;489(7414):57-74. doi: 10.1038/nature11247.
Estivill, et al. Copy number variants and common disorders: filling the gaps and exploring complexity in genome-wide association studies. PLoS Genet. Oct. 2007;3(10):1787-99.
Fan, et al. Illumina universal bead arrays. Methods Enzymol. 2006;410:57-73.
Fernandez, et al. Disruption of contactin 4 (CNTN4) results in developmental delay and other features of 3p deletion syndrome. Addendum. Am J Hum Genet. Jun. 2008;82(6):1385.
Fernandez, et al. Disruption of contactin 4 (CNTN4) results in developmental delay and other features of 3p deletion syndrome. Am J Hum Genet. Jun. 2004;74(6):1286-93.
Fire, et al. Potent and specific genetic interference by double-stranded RNA in Caenorhabditis elegans. Nature. Feb. 19, 1998;391(6669):806-11.

(56) References Cited

OTHER PUBLICATIONS

Freeman, et al. Copy number variation: new insights in genome diversity. Genome Res. Aug. 2006;16(8):949-61. Epub Jun. 29, 2006.
Galfre. et al. Antibodies to major histocompatibility antigens produced by hybrid cell lines. Nature. 1977; 266:550-52.
Gilling, et al. Breakpoint cloning and haplotype analysis indicate a single origin of the common Inv(10)(p11.2q21.2) mutation among northern Europeans. Am. J. Hum. Genet. 2006; 78(5):878-83.
Glessner, et al. Autism genome-wide copy No. variation reveals ubiquitin and neuronal genes. Nature. May 28, 2009;459(7246):569-73. Epub Apr. 28, 2009.
Goldstein. Common genetic variation and human traits. N Engl J Med. Apr. 23, 2009;360(17):1696-8. Epub Apr. 15, 2009.
Gregoriadis. Chapter 14, "Liposomes," Drug Carriers in Biology and Medicine, pp. 2.sup.87-341 (Academic Press, 1979).
Gribble, et al. The complex nature of constitutional de novo apparently balanced translocations in patients presenting with abnormal phenotypes. J. Med. Genet. 2005; 42:8-16.
Griffiths, et al. Human anti-self antibodies with high specificity from phage display libraries. EMBO J. Feb. 1993;12(2):725-34.
Grskovic, et al. Induced pluripotent stem cells--opportunities for disease modelling and drug discovery. Nat Rev Drug Discov. Nov. 11, 2011;10(12):915-29. doi: 10.1038/nrd3577.
Harada, et al. Subtelomere specific microarray based comparative genomic hybridisation: a rapid detection system for cryptic rearrangements in idiopathic mental retardation. J. Med. Genet. 2004; 41:130-136.
Hatchwell, et al. High rate of submicroscopic human genomic polymorphism detected by array CGH. Proceedings of XIX International Genetics Congress. Melbourne, Australia. Abstracts and Posters. 2003; 1.E.0092. pp. 168 and 319.
Hay, et al. Bacteriophage cloning and *Escherichia coli* expression of a human IgM Fab. Hum Antibodies Hybridomas. Apr. 1992;3(2):81-5.
Helbig, et al. 15q13.3 microdeletions increase risk of idiopathic generalized epilepsy. Nat Genet. Feb. 2009;41(2):160-2. Epub Jan. 11, 2009.
Hicks et al., "Novel patterns of genome rearrangement and their association with survival in breast cancer," Genome Res 16:1465-1479, 2006.
Hoffman, et al. Pharmacokinetic and pharmacodynamic aspects of gastroretentive dosage forms. Int J Pharm. Jun. 11, 2004;277(1-2):141-53.
Hoheisel, J. Microarray technology: beyond transcript profiling and genotype analysis. Nat Rev Genet. Mar. 2006;7(3):200-10.
Huang, et al. Whole genome DNA copy number changes identified by high density oligonucleotide arrays. Hum Genomics. May 2004;1(4):287-99.
Hunter, C. Genetics: a touch of elegance with RNAi. Curr Biol. Jun. 17, 1999;9(12):R440-2.
Huse, et al. Generation of a large combinatorial library of the immunoglobulin repertoire in phage lambda. Science. Dec. 8, 1989;246(4935):1275-81.
Hutvagner, et al. A microRNA in a multiple-turnover RNAi enzyme complex. Science. Sep. 20, 2002;297(5589):2056-60. Epub Aug. 1, 2002.
Iafrate, et al. Detection of large-scale variation in the human genome. Nature Genet. 2004; 36:949-51.
International search report and written opinion dated Apr. 9, 2012 for PCT/US2011/001363.
International Search Report dated Sep. 11, 2008 for PCT Application No. US2007/68183.
Itsara, et al. Population analysis of large copy number variants and hotspots of human genetic disease. Am J Hum Genet. Feb. 2009;84(2):148-61. Epub Jan. 22, 2009.
Jorde, et al. Population genomics: a bridge from evolutionary history to genetic medicine. Hum. Mol. Genet. 2001; 10(20):2199-2207.
Kallioniemi, et al. Comparative genomic hybridization for molecular cytogenetic analysis of solid tumors. Science. Oct. 30, 1992;258(5083):818-21.
Karlin, et al. Applications and statistics for multiple high-scoring segments in molecular sequences. Proc Natl Acad Sci U S A. Jun. 15, 1993;90(12):5873-7.
Ketting, et al. Dicer functions in RNA interference and in synthesis of small RNA involved in developmental timing in C. elegans. Genes Dev. Oct. 15, 2001;15(20):2654-9.
Kim, et al. Strategies for silencing human disease using RNA interference. Nat Rev Genet. Mar. 2007;8(3):173-84.
Kim, et al. Synthetic dsRNA Dicer substrates enhance RNAi potency and efficacy. Nat Biotechnol. Feb. 2005;23(2):222-6. Epub Dec. 26, 2004.
Kimchi-Sarfaty, et al. A "silent" polymorphism in the MDR1 gene changes substrate specificity. Science. Jan. 26, 2007;315(5811):525-8. Epub Dec. 21, 2006.
Klausner, et al. Novel gastroretentive dosage forms: evaluation of gastroretentivity and its effect on levodopa absorption in humans. Pharm Res. Sep. 2003;20(9):1466-73.
Klein, et al. Comparative genomic hybridization, loss of heterozygosity, and DNA sequence analysis of single cells. Proc Natl Acad Sci U S A. Apr. 13, 1999;96(8):4494-9.
Kohler, et al. Continuous cultures of fused cells secreting antibody of predefined specificity. Nature. Aug. 7, 1975;256(5517):495-7.
Kozbor, et al. The production of monoclonal antibodies from human lymphocytes. Immunol Today. 1983; 4(3): 72-79.
Kraus, et al. Detection and isolation of novel protein-tyrosine kinase genes employing reduced stringency hybridization. Methods Enzymol. 1991;200:546-56.
Kumar, et al. A de novo 1p34.2 microdeletion identifies the synaptic vesicle gene RIMS3 as a novel candidate for autism. J Med Genet. Jun. 21, 2009. [Epub ahead of print].
Kumar, et al. Recurrent 16p11.2 microdeletions in autism. Hum Mol Genet. Feb. 15, 2008;17(4):628-38. Epub Dec. 21, 2007.
Kurreck, J. Antisense technologies. Improvement through novel chemical modifications. Eur J Biochem. Apr. 2003;270(8):1628-44.
Kutyavin, et al. A novel endonuclease IV post-PCR genotyping system. Nucleic Acids Res. 2006;34(19):e128. Epub Sep. 29, 2006.
Lavery, et al. Antisense and RNAi: powerful tools in drug target discovery and validation. Curr Opin Drug Discov Devel. Jul. 2003;6(4):561-9.
Lerner, E. How to make a hybridoma. Yale J Biol Med. Sep.-Oct. 1981;54(5):387-402.
Maftei, et al. Interaction structure of the complex between neuroprotective factor humanin and Alzheimer's β-amyloid peptide revealed by affinity mass spectrometry and molecular modeling. J Pept Sci. Jun. 2012;18(6):373-82. doi: 10.1002/psc.2404. Epub Apr. 20, 2012.
Maniatis, et al. Molecular Cloning: A Laboratory Manual, Cold Spring Harbor Laboratory Press, Cold Spring Harbor, N. Y., USA (1982).
Manolio, et al.Finding the missing heritability of complex diseases. Nature. Oct. 8, 2009;461(7265):747-53.
Margulies, et al. Genome sequencing in microfabricated high-density picolitre reactors. Nature. Sep. 15, 2005;437(7057):376-80. Epub Jul. 31, 2005.
Marques, et al. A structural basis for discriminating between self and nonself double-stranded RNAs in mammalian cells. Nat Biotechnol. May 2006;24(5):559-65. Epub Apr. 30, 2006.
Martinez, et al. Single-stranded antisense siRNAs guide target RNA cleavage in RNAi. Cell. Sep. 6, 2002;110(5):563-74.
Mast, et al. Invader assay for single-nucleotide polymorphism genotyping and gene copy number evaluation. Methods Mol Biol. 2006;335:173-86. Abstract only.
Matsuoka, et al. Humanin and the receptors for humanin. Mol Neurobiol. Feb. 2010;41(1):22-8. Epub Dec. 9, 2009.
McCarroll, et al. Copy-number variation and association studies of human disease. Nat Genet. Jul. 2007;39(7 Suppl):S37-42.
McCarthy, et al. Microduplications of 16p11.2 are associated with schizophrenia. Nat Genet. Nov. 2009;41(11):1223-7. Epub Oct. 25, 2009.
McManus, et al. Gene silencing in mammals by small interfering RNAs. Nat Rev Genet. Oct. 2002;3(10):737-47.

(56) References Cited

OTHER PUBLICATIONS

Mockler, et al. Applications of DNA tiling arrays for whole-genome analysis. Genomics. Jan. 2005;85(1):1-15.
Nielsen, et al. Sequence-selective recognition of DNA by strand displacement with a thymine-substituted polyamide. Science. Dec. 6, 1991;254(5037):1497-500.
Nord, et al. Accurate and exact CNV identification from targeted high-throughput sequence data. BMC Genomics. Apr. 12, 2011;12:184.
Nykanen, et al. ATP requirements and small interfering RNA structure in the RNA interference pathway. Cell. Nov. 2, 2001;107(3):309-21.
Office action dated Jan. 6, 2011 for U.S. Appl. No. 12/707,561.
Office action dated Sep. 13, 2012 for Chinese Application No. 200780015873.8.
Office action dated Dec. 16, 2008 for U.S. Appl. No. 11/421,348.
Office action dated Jun. 14, 2010 for UK Application No. GB0822081.6.
Office action dated Jun. 2, 2009 for U.S. Appl. No. 11/421,348.
Ozelius, et al. LRRK2 G2019S as a cause of Parkinson's disease in Ashkenazi Jews. N Engl J Med. Jan. 26, 2006;354(4):424-5.
Pang, et al. Towards a comprehensive structural variation map of an individual human genome. Genome Biol. 2010;11(5):R52. Epub May 19, 2010
Peltz, et al. Targeting post-transcriptional control for drug discovery. RNA Biol. Jul.-Aug. 2009;6(3):329-34. Epub Jul. 7, 2009.
Perkel, J. SNP genotyping: six technologies that keyed a revolution. Nature Methods. 2008; 5:447-453.
Pinkel, et al. Comparative genomic hybridization. Annu. Rev. Genomics Hum. Genet. 2005; 6:331-54.
Pinkel, et al. High resolution analysis of DNA copy number variation using comparative genomic hybridization to microarrays. Nat Genet. Oct. 1998;20(2):207-11.
Pinto, et al. Functional impact of global rare copy number variation in autism spectrum disorders. Nature. Jul. 15, 2010;466(7304):368-72. Epub Jun. 9, 2010.
Plasterk, et al. The silence of the genes. Curr Opin Genet Dev. Oct. 2000;10(5):562-7.
Pollack, et al. Microarray analysis reveals a major direct role of DNA copy number alteration in the transcriptional program of human breast tumors. Proc. Natl. Acad. Sci. 2002; 99(20):12963-68.
Provost, et al. Ribonuclease activity and RNA binding of recombinant human Dicer. EMBO J. Nov. 1, 2002;21(21):5864-74.
Ramsey, et al. A CFTR potentiator in patients with cystic fibrosis and the G551D mutation. N Engl J Med. Nov. 3, 2011;365(18):1663-72.
Raqoussis, et al. Affymetrix GeneChip system: moving from research to the clinic. Expert Rev Mol Diagn. Mar. 2006;6(2):145-52.
Redon, et al. Global variation in copy number in the human genome. Nature. Nov. 23, 2006;444(7118):444-54.
Remington "The Science and Practice of Pharmacy" (20th Ed., Lippincott Williams & Wilkins, Baltimore MD).
Reynold, et al. Rational siRNA design for RNA interference. Nat Biotechnol. Mar. 2004;22(3):326-30. Epub Feb. 1, 2004.
Rodriguez-Revenga, et al. Structural variation in the human genome: the impact of copy number variants on clinical diagnosis. Genet Med. Sep. 2007;9(9):600-6.
Roohi, et al. Disruption of contactin 4 in three subjects with autism spectrum disorder. J Med Genet. Mar. 2009;46(3):176-82.
Rosenzweig and Nabel (Eds), Current Protocols in Human Genetics (esp. Ch. 13 therein, "Delivery Systems for Gene Therapy", 2008 John Wiley & Sons, NY).
Saha, et al. Technical challenges in using human induced pluripotent stem cells to model disease. Cell Stem Cell. Dec. 4, 2009;5(6):584-95.
Sambrook et al., Molecular Cloning: A Laboratory Manual (2 ed.), Cold Spring Harbor Laboratory Press, Cold Spring Harbor, N. Y., USA (1989).
Schule, et al. Can cellular models revolutionize drug discovery in Parkinson's disease? Biochim Biophys Acta. Nov. 2009;1792(11):1043-51. Epub Sep. 3, 2009.

Schwarz, et al. Asymmetry in the assembly of the RNAi enzyme complex. Cell. Oct. 17, 2003;115(2):199-208.
Sebat, et al. Large-scale copy number polymorphism in the human genome. Science. 2004; 305(5683):525-8.
Sebat, et al. Strong association of de novo copy number mutations with autism. Science. Apr. 20, 2007;316(5823):445-9.
Sharp, P. RNA interference—2001. Genes Dev. Mar. 1, 2001;15(5):485-90.
Shi, Y. Mammalian RNAi for the masses. Trends Genet. Jan. 2003;19(1):9-12.
Shuey, et al. RNAi: gene-silencing in therapeutic intervention. Drug Discov Today. Oct. 15, 2002;7(20):1040-6.
Siolas, et al. Synthetic shRNAs as potent RNAi triggers. Nat Biotechnol. Feb. 2005;23(2):227-31. Epub Dec. 26, 2004.
Smith, et al. A high-density admixture map for disease gene discovery in african americans. Am J Hum Genet. May 2004;74(5):1001-13. Epub Apr. 14, 2004.
Snijders, et al. Assembly of microarrays for genome-wide measurement of DNA copy number. Nat Genet. Nov. 2001;29(3):263-4.
Snijders, et al. BAC microarray-based comparative genomic hybridization. Methods Mol Biol. 2004;256:39-56.
Snijders, et al. Mapping segmental and sequence variations among laboratory mice using BAC array CGH. Genome Res. Feb. 2005;15(2):302-11.
Soni, et al. Progress toward ultrafast DNA sequencing using solid-state nanopores. Clin Chem. Nov. 2007;53(11):1996-2001. Epub Sep. 21, 2007.
Stefansson, et al. Large recurrent microdeletions associated with schizophrenia. Nature. Sep. 11, 2008;455(7210):232-6.
Stephens, et al. Antisense oligonucleotide therapy in cancer. Curr Opin Mol Ther. Apr. 2003;5(2):118-22.
Streubel, et al. Gastroretentive drug delivery systems. Expert Opin Drug Deliv. Mar. 2006;3(2):217-33.
Summary of NRSP-8 Accomplishments: 2003-2008. Available at http://www.lgu.umd.edu/lgu_v2/pages/attachs/9956_Attach1%20%202003-08%20ACCOMPLISHMENTS.doc. Published on Feb. 9, 2008. (6 pages).
Szoka, et al. Procedure for preparation of liposomes with large internal aqueous space and high capture by reverse-phase evaporation. Proc Natl Acad Sci U S A. Sep. 1978;75(9):4194-8.
Tabara, et al. The dsRNA binding protein RDE-4 interacts with RDE-1, DCR-1, and a DExH-box helicase to direct RNAi in C. elegans. Cell. Jun. 28, 2002;109(7):861-71.
Tabuchi, et al. A neuroligin-3 mutation implicated in autism increases inhibitory synaptic transmission in mice. Science. Oct. 5, 2007;318(5847):71-6. Epub Sep. 6, 2007.
Teo, et al. Statistical challenges associated with detecting copy number variations with next-generation sequencing. Bioinformatics. Aug. 31, 2012.
The International Schizophrenia Consortium. Rare chromosomal deletions and duplications increase risk of schizophrenia. Nature. Sep. 11, 2008;455(7210):237-41. Epub Jul. 30, 2008.
The Merck Manual of Diagnosis and Therapy, 18th Edition, published by Merck Research Laboratories, 2006 (ISBN 0-911910-18-2).
Thompson. Applications of antisense and siRNAs during preclinical drug development. Drug Discov Today. Sep. 1, 2002;7(17):912-7.
Urnov, et al. Genome editing with engineered zinc finger nucleases. Nat Rev Genet. Sep. 2010;11(9):636-46.
Van Goor, et al. Correction of the F508del-CFTR protein processing defect in vitro by the investigational drug VX-809. Proc Natl Acad Sci U S A. Nov. 15, 2011;108(46):18843-8. Epub Oct. 5, 2011.
Van Goor, et al. Rescue of CF airway epithelial cell function in vitro by a CFTR potentiator, VX-770. Proc Natl Acad Sci U S A. Nov. 3, 2009;106(44):18825-30. Epub Oct. 21, 2009.
Vickers, et al. Efficient reduction of target RNAs by small interfering RNA and RNase H-dependent antisense agents. A comparative analysis. J Biol Chem. Feb. 28, 2003;278(9):7108-18. Epub Dec. 23, 2002.
Vissers, et al. Array-based comparative genomic hybridization for the genomewide detection of submicroscopic chromosomal abnormalities. Am. J. Hum. Genet. 2003; 73:1261-70.

(56) References Cited

OTHER PUBLICATIONS

Vissers, et al. Identification of disease genes by whole genome CGH arrays. Hum Mol Genet. Oct. 15, 2005;14 Spec No. 2:R215-223.
Walsh, et al. Detection of inherited mutations for breast and ovarian cancer using genomic capture and massively parallel sequencing. Proc Natl Acad Sci U S A. Jul. 13, 2010;107(28):12629-33. Epub Jun. 28, 2010.
Walsh, et al. Spectrum of mutations in BRCA1, BRCA2, CHEK2, and TP53 in families at high risk of breast cancer. JAMA. Mar. 22, 2006;295(12):1379-88.
Walters, et al. A new highly penetrant form of obesity due to deletions on chromosome 16p11.2. Nature. Feb. 4, 2010;463(7281):671-5.
Wang, et al. Antisense anticancer oligonucleotide therapeutics. Curr Cancer Drug Targets. Nov. 2001;1(3):177-96.
Weiss, et al. Association between microdeletion and microduplication at 16p11.2 and autism. N Engl J Med. Feb. 14, 2008;358(7):667-75. .
Westmark, C. What's hAPPening at synapses? the role of amyloid β-protein precursor and β-amyloid in neurological disorders. Mol Psychiatry. Aug. 28, 2012. doi: 10.1038/mp.2012.122.
Wilson, et al. DNA copy-number analysis in bipolar disorder and schizophrenia reveals aberrations in genes involved in glutamate signaling. Hum Mol Genet. Mar. 1, 2006;15(5):743-9. Epub Jan. 24, 2006.
Xia, et al. siRNA-mediated gene silencing in vitro and in vivo. Nat Biotechnol. Oct. 2002;20(10):1006-10. Epub Sep. 16, 2002.
Xie, et al. CNV-seq, a new method to detect copy number variation using high-throughput sequencing. BMC Bioinformatics. Mar. 6, 2009;10:80.
Yusa, et al. Targeted gene correction of α1-antitrypsin deficiency in induced pluripotent stem cells. Nature. Oct. 12, 2011;478(7369):391-4. doi: 10.1038/nature10424.
Zapala, et al. Humanins, the neuroprotective and cytoprotective peptides with antiapoptotic and anti-inflammatory properties. Pharmacol Rep. Sep.-Oct. 2010;62(5): 767-77.
Zhang, et al. Copy number variation in human health, disease, and evolution. Annu Rev Genomics Hum Genet. 2009;10:451-81.
Zhang, et al. Detection of copy number variation from array intensity and sequencing read depth using a stepwise Bayesian model. BMC Bioinformatics. Oct. 31, 2010;11:539.
Office action dated Apr. 3, 2013 for U.S. Appl. No. 13/095,722.
Daruwala, et al. A versatile statistical analysis algorithm to detect genome copy number variation. Proc Natl Acad Sci U S A. Nov. 16, 2004;101(46):16292-7. Epub Nov. 8, 2004.
European search report and opinion dated Feb. 27, 2015 for EP Application No. 11814903.8.
Bult, et al. The Mouse genome Database (MGD): mouse biology and model systems. Nucleic Acids Research. 2008; 36 Database Issue: D724-D728. doi:10.1093/nar/gkm961.
Gatto, et al. Genetic controls balancing excitatory and inhibitory synaptogenesis in neurodevelopmental disorder models. Frontiers in Synaptic Neuroscience. Jun. 2010; 2(4):1-19.
International search report and written opinion dated Jun. 21, 2013 for PCT/IB2012/002498.
International search report and written opinion dated Jul. 3, 2013 for PCT/IB2012/002498.
Office action dated Jul. 17, 2013 for U.S. Appl. No. 12/449,566.
Rees, et al. Isoform heterogeneity of the human gephyrin gene (GPHN), binding domains to the glycine receptor, and mutation analysis in hyperekplexia. J Biol Chem. Jul. 4, 2003;278(27):24688-96. Epub Apr. 8, 2003.
Risch, et al. A genomic screen of autism: evidence for a multilocus etiology. Am J Hum Genet. Aug. 1999;65(2):493-507.
Veensra-Vanderweele, et al. Networking in autism: leveraging genetic, biomarker and model system findings in the search for new treatments. Neuropsychopharmacology. Jan. 2012;37(1):196-212. doi: 10.1038/npp.2011.185. Epub Sep. 21, 2011.
U.S. Appl. No. 14/449,217, filed Aug. 1, 2014, Hatchwell et al.
Notice of allowance dated Jul. 25, 2014 for U.S. Appl. No. 13/196,882.

Office action dated May 28, 2014 for U.S. Appl. No. 12/449,566.
U.S. Appl. No. 14/039,770, filed Sep. 27, 2013, Hatchwell et al.
Office action dated Nov. 18, 2013 for U.S. Appl. No. 13/196,882.
European search report dated Oct. 14, 2015 for EP Application No. 13746934.2.
U.S. Appl. No. 14/806,131, filed Jul. 22, 2015, Chinitz et al.
Abravaya, et al. Detection of point mutations with a modified ligase chain reaction (Gap-LCR). Nucleic Acids Research. 1995;23(4):675-682.
Bernard, et al. Sequence of the murine and human cellular myc oncogenes and two modes of myc transcription resulting from chromosome translocation in B lymphoid tumours. EMBO J. 1983;2(12):2375-83.
Dijkhuizen, et al. FISH and array-CGH analysis of a complex chromosome 3 aberration suggests that loss of CNTN4 and CRBN contributes to mental retardation in 3pter deletions. Am J Med Genet A. Nov. 15, 2006;140(22):2482-7.
Fernandez, et al. Gene Discovery in Developmental Neuropsychiatric Disorders: Clues from Chromosomal Rearrangements. Yale Journal of Biology and Medicine, vol. 78 (2005), pp. 95-130. on p. 103. Abstract.
Gelmann, et al. Identification of reciprocal translocation sites within the c-myc oncogene and immunoglobulin mu locus in a Burkitt lymphoma. Nature. Dec. 22-Jan. 4, 1984;306(5945):799-803.
Guatelli, et al. Isothermal, in vitro amplification of nucleic acids by a multienzyme reaction modeled after retroviral replication. Proc Natl Acad Sci U S A. Mar. 1990;87(5):1874-8.
Kwoh, et al. Transcription-based amplification system and detection of amplified human immunodeficiency virus type 1 with a bead-based sandwich hybridization format. Proc Natl Acad Sci U S A. Feb. 1989;86(4):1173-7.
Landegren, et al. A ligase-mediated gene detection technique. Science. Aug. 26, 1988;241(4869):1077-80.
Lizardi, et al. Exponential amplification of recombinant-RNA hybridization probes. Nature Biotechnology 6.10 (1988): 1197-1202.
Mohapatra, et al. Analyses of brain tumor cell lines confirm a simple model of relationships among fluorescence in situ hybridization, DNA index, and comparative genomic hybridization. Genes Chromosomes Cancer. Dec. 1997;20(4):311-9.
Nakazawa, et al. UV and skin cancer: specific p53 gene mutation in normal skin as a biologically relevant exposure measurement. Proc Natl Acad Sci U S A. Jan. 4, 1994;91(1):360-4.
Office action dated Sep. 2, 2015 for U.S. Appl. No. 12/449,566.
Petrini, et al. The immunoglobulin heavy chain switch: structural features of gamma 1 recombinant switch regions. J Immunol Mar. 15, 1987;138(6):1940-6.
Saiki, et al. Primer-directed enzymatic amplification of DNA with a thermostable DNA polymerase. Science. Jan. 29, 1988;239(4839):487-91.
European search report and opinion dated Jun. 9, 2015 for EP Application No. 12846660.4.
GeneCards output for ATXN2 gene, from www.genecards.ord, pritned on May 20, 2015, pp. 1-13.
Juppner. Functional properties of the PTH/PTHrP receptor. Bone. Aug. 1995; 17(2):Supplement 39S-42S.
Lucentini. Gene association typically wrong reproducible gene-disease associations are few and far between. The Scientist, Dec. 20, 2004, p. 20.
McInnes, et al. A large-scale survey of the novel 15q24 microdeletion syndrome in autism spectrum disorders identifies an atypical deletion that narrows the critical region. Mol Autism. Mar. 19, 2010;1(1):5. doi: 10.1186/2040-2392-1-5.
Pennisi. A closer look at SNPs suggests difficulties. Science. Sep 18, 1998; 281(5384): 1787-1789.
Calvo, et al. High-throughput, pooled sequencing identifies mutations in NUBPL and FOXRED1 in human complex I deficiency. Nat Genet. Oct. 2010;42(10):851-8. Epub Sep. 5, 2010.
Gagneux, et al. Genetic differences between humans and great apes. Mol Phylogenet Evol. Jan. 2001;18(1):2-13.
GPHN Gene—GeneCards output. pp. 1-14. Printed on Jul. 2, 2015 from www.genecards.org.
Hattersley, et al. What makes a good genetic association study? Lancet. Oct. 8, 2005;366(9493):1315-23.

(56) References Cited

OTHER PUBLICATIONS

Hirschhorn, et al. A comprehensive review of genetic association studies. Genet Med. Mar.-Apr. 2002;4(2):45-61.
International search report and written opinion dated Jan. 20, 2014 for PCT/US2013/059739.
International search report and written opinion dated Apr. 22, 2013 for PCT/US2012/063451.
Mummidi, et al. Evolution of human and non-human primate CC chemokine receptor 5 gene and mRNA. Potential roles for haplotype and mRNA diversity, differential haplotype-specific transcriptional activity, and altered transcription factor binding to polymorphic nucleotides in the pathogenesis of HIV-1 and simian immunodeficiency virus. J Biol Chem. Jun. 23, 2000;275(25):18946-61.
Nalls, et al. Extended tracts of homozygosity identify novel candidate genes associated with late-onset Alzheimer's disease. Neurogenetics. Jul. 2009;10(3):183-90. doi: 10.1007/s10048-009-0182-4. Epub Mar. 7, 2009.
Nalls, et al. Imputation of sequence variants for identification of genetic risks for Parkinson's disease: a meta-analysis of genome-wide association studies. Lancet. Feb. 19, 2011;377(9766):641-9. doi: 10.1016/S0140-6736(10)62345-8. Epub Feb. 1, 2011.
NCBI GenBank accession No. NM_207303.1. Apr. 20, 2004.
NCBI. GenBank accession No. AL390798.3. Human chromosome 14 DNA sequence BAC R-21O19 of library RPCI-11 from chromosome 14 of *Homo sapiens* (Human), complete sequence. Apr. 28, 2011.
Office action dated Jun. 29, 2015 for U.S. Appl. No. 14/026,642.
Office action dated Jul. 9, 2015 for U.S. Appl. No. 13/648,874.
Office action dated Aug. 4, 2015 for U.S. Appl. No. 13/668,049.
Office action dated Oct. 3, 2014 for U.S. Appl. No. 13/668,049.
Schapira, et al. Mitochondrial complex I deficiency in Parkinson's disease. Lancet. Jun. 3, 1989;1(8649):1269.
Schapira. Causes of neuronal death in Parkinson's disease. Adv Neurol. 2001;86:155-62.
Schapira. Mitochondrial complex I deficiency in Parkinson's disease. Adv Neurol. 1993;60:288-91.
Simon-Sanchez, et al. Genome-wide association study reveals genetic risk underlying Parkinson's disease. Nat Genet. Dec. 2009;41(12):1308-12. doi: 10.1038/ng.487. Epub Nov. 15, 2009. with supplemental information.
Stark, et al. De novo 325 kb microdeletion in chromosome band 10q25.3 including ATRNL1 in a boy with cognitive impairment, autism and dysmorphic features. Eur J Med Genet. Sep.-Oct. 2010;53(5):337-9. doi: 10.1016/j.ejmg.2010.07.009. Epub Jul. 27, 2010.
Thorpe, et al. Improved antitumor effects of immunotoxins prepared with deglycosylated ricin A-chain and hindered disulfide linkages. Cancer Res. Nov. 15, 1988;48(22):6396-403.
Vaughan, et al. Genetics of Parkinsonism: a review. Ann Hum Genet. Mar. 2001;65(Pt 2):111-26.
Walker, et al. Genetic analysis of attractin homologs. Genesis. 2007; 45(12):744-756.
Crespi, et al. Association testing of copy number variants in schizophrenia and autism spectrum disorders. J Neurodev Disord. May 30, 2012;4(1):15. doi: 10.1186/1866-1955-4-15.
European search report dated Apr. 11, 2016 for EP Application No. 13840476.9.
Guilmatre, et al. Recurrent rearrangements in synaptic and neurodevelopmental genes and shared biologic pathways in schizophrenia, autism, and mental retardation. Arch Gen Psychiatry. Sep. 2009;66(9):947-56. doi: 10.1001/archgenpsychiatry.2009.80.
He, et al. Analysis of de novo copy number variations in a family affected with autism spectrum disorders using high-resolution array-based comparative genomic hybridization. Zhonghua Yi Xue Yi Chuan Xue Za Zhi. Jun. 2012;29(3):266-9. doi: 10.3760/cma.j.issn.1003-9406.2012.03.004. English abstract only.
Office action dated Feb. 25, 2016 for U.S. Appl. No. 13/648,874.
Office action dated Feb. 29, 2016 for U.S. Appl. No. 14/026,642.
Office action dated May 17, 2016 for U.S. Appl. No. 14/090,932.
Office action dated Jun. 28, 2016 for U.S. Appl. No. 12/449,566.

O'Keefe, et al. High-resolution genomic arrays facilitate detection of novel cryptic chromosomal lesions in myelodysplastic syndromes. Exp Hematol. Feb. 2007;35(2):240-51.
Prasad, et al. A discovery resource of rare copy No. variations in individuals with autism spectrum disorder. G3 (Bethesda). Dec. 2012;2(12):1665-85. doi: 10.1534/g3.112.004689. Epub Dec. 1, 2012.
Tam, et al. The role of DNA copy number variation in schizophrenia. Biol Psychiatry. Dec. 1, 2009;66(11):1005-12. doi: 10.1016/j.biopsych.2009.07.027. Epub Sep. 12, 2009.
Ziats, et al. Expression profiling of autism candidate genes during human brain development implicates central immune signaling pathways. PLoS One. 2011;6(9):e24691. doi: 10.1371/journal.pone.0024691. Epub Sep. 15, 2011.
Alexander Zimprich, et al., A mutation in, encoding a subunit of the retromer complex, causes late-onset parkinson disease, American journal of human genetics, American society of human genetics. Jun. 2011; 89(1):168-175.
Carles Vilario-Guell, et al., Mutations in Parkinson disease, American journal of human genetics, american society of human genetics. Jun. 2011; 89(1):162-167.
Co-pending U.S. Appl. No. US15/279,012, filed Sep. 28, 2016.
Corti, et al. What Genetics tells us about the causes and mechanisms of parkinson's disease. Physiological reviews.Oct. 2011; 91(4): 1161-1218.
European Search Report dated Sep. 2, 2016 for European Application No. 13836501.0.
"Introducing Genome-Wide SNP Array 6.0 Pure performance & Genetic Power." May 21, 2008. Available at http://www.genehk.com/news/doc/Genomics_genome-wide Human SNP Array 6.0.pdf. Accessed on Dec. 22, 2016.
Kumar Kishore, et al., Genetics of parkinson disease and other movement disorders, Current opinion in neurology, Aug. 2012; 25(4):466-474.
Latchman, et al. Viral vectors for gene therapy in Parkinson's disease. Rev Neurosci. 2001;12(1):69-78.
Lucentini, et al. Gene association studies typically wrong. Reproducible gene-disease associations are few and far between. The Scientist. 2004; 18(24):20.
Office Action dated Feb. 24, 2016 for U.S. Appl. No. 14/039,770.
Office Action dated May 27, 2015 for U.S. Appl. No. 14/039,770.
UK Parkinson's Disease Consortium et al., Dissection of the genetics of parkinson's disease identifies an additional association 5' of SNCA and multiple associated haplotypes at 17q21. Human Molecular genetics. Jan. 15, 2011; 20(2): 345-353.
Office Action dated Oct. 19, 2016 for European Application No. 12846660.4.
Office Action dated Dec. 6, 2016 for U.S. Appl. No. 14/026,642.
Office action dated Feb. 9, 2011 for UK Application No. GB0822081.6.
Paisan-Ruiz Coro, et al., Parkingson's disease and low frequency alleles foung together throughout LRRK2, Annals of human genetics. Jul. 2009. 73(4). 391-403.
Ching, et al., Integrated analysis of copy number and loss of heterozygosity in primary breast carcinomas using high-density SNP array. International journal of oncology, 2011; 39:621-633.
Langston, et al., Multisystem Lewy body disease and the other parkinsonian disorders. Nature Genetics. Dec. 2015; 47(12):1378-1385.
Liu, Qing-Rong, et al. "Addiction molecular genetics: 639,401 SNP whole genome association identifies many "cell adhesion" genes. "American Journal of Medical Genetics Part B: Neuropsychiatric Genetics val. 141 (2006): pp. 918-925.
Office Action dated Apr. 13, 2017 for U.S. Appl. No. 13/648,874.
Office Action dated Apr. 13, 2017 for U.S. Appl. No. 14/039,770.
Office Action dated May 25, 2017 for U.S. Appl. No. 13/668,049.
Poewe, et al., Parkinson disease. Nature Review:Disease Primers. Mar. 23, 2017.vol. 3, Article 17013: 1-21.
Purcell et al. "Postmortem brain abnormalities of the glutamate neurotransmitter system in autism" (Neurology, vol. 57 (2001) pp. 1618-1628).

(56) References Cited

OTHER PUBLICATIONS

Zeng, Li, et al. "A novel splice variant of the cell adhesion molecule contactin 4 (CNTN4) is mainly expressed in human brain." Journal of human genetics val. 47 (2002): pp. 497-499.
CNV: 14q23.3 summary output from https://gene.sfari.org/database/cnv/14q23.3 Nov. 30, 2017, pp. 1-3. (year: 2017).
Copy Number Variants summary for 12q23.3-q24.13 from gene.sfari.org/database/cnv/, two pages printed on Dec. 2, 2017. (Year:2017).
Office Action dated Oct. 10, 2017 for U.S. Appl. No. 14/449,217.
Office Action dated Oct. 13, 2017 for U.S. Appl. No. 14/806,131.
Office Action dated Dec. 5, 2017 for U.S. Appl. No. 13/648,874.
Office Action dated Dec. 29, 2017 for U.S. Appl. No. 13/668,049.
Office Action dated Dec. 7, 2017 for U.S. Appl. No. 14/039,770.
NCBI SNP Database rs201412882, ss491686165, Mar. 6, 2012 (National Library of Medicine, NIH, Bethesda, MD, USA).
Notice of Allowance dated Jan. 11, 2018 for U.S. Appl. No. 14/026,642.
Chen, et al., Correlation between SMN2 copies and phenotype of spinal muscualr atrophy. Chin J Neurol, Nov. 30, 2005; 38(11):673-676.
Co-pending U.S. Appl. No. 16/029,125, filed Jul. 6, 2018.
Gokcumen, et al., Copy number variants (CNVs) in primate species using array-based comparative genomic hybridization. Methods 2009;49:18-25.
Munoz-Amatriain et al., Distribution, functional impact, and origin mechanisms of copy number variation in the barley genome. Genome Biology, 2013; 14:r58 pp. 1-17.
U.S. Appl. No. 12/449,566 Notice of Allowance dated Oct. 27, 2018.
U.S. Appl. No. 13/648,874 Notice of Allowance dated Oct. 4, 2018.
U.S. Appl. No. 14/039,770 Notice of Allowance dated Sep. 27, 2018.
U.S. Appl. No. 14/090,932 Office Action dated Sep. 27, 2018.
U.S. Appl. No. 14/449,217 Notice of Allowance dated Apr. 11, 2018.
U.S. Appl. No. 14/806,131 Office Action dated Jun. 21, 2018.

\* cited by examiner

METHODS AND COMPOSITIONS FOR SCREENING AND TREATING DEVELOPMENTAL DISORDERS

CROSS-REFERENCE

This application claims the benefit of U.S. Provisional Application No. 61/633,323, filed Feb. 9, 2012, which application is incorporated herein by reference in its entirety.

REFERENCE TO A SEQUENCE LISTING

The present application includes a Sequence Listing. A compact disc labeled "COPY 1 of 3" contains a computer readable form of the Sequence Listing file named 33655-708.202_PDx_SK_ST25.txt. The Sequence Listing is 427,489,280 bytes in size and was recorded on Feb. 9, 2013. The compact disc is 1 of 3 compact discs. Duplicate copies of the compact disc are labeled "COPY 2 of 3," and "COPY 3 of 3." The compact disc and duplicate copies are identical and are hereby incorporated by reference into the present application

BACKGROUND OF THE INVENTION

Genetic risk can be conferred by subtle differences in individual genomes within a population. Genes can differ between individuals due to genomic variability, the most frequent of which are due to single nucleotide polymorphisms (SNPs). SNPs can be located, on average, every 500-1000 base pairs in the human genome. Additional genetic polymorphisms in a human genome can be caused by duplication, insertion, deletion, translocation and/or inversion, of short and/or long stretches of DNA. Thus, in general, genetic variability among individuals occurs on many scales, ranging from single nucleotide changes, to gross changes in chromosome structure and function. Recently, many copy number variations (CNVs) of DNA segments, including deletions, insertions, duplications, amplifications and complex multi-site variants, ranging in length from kilobases to megabases in size, have been discovered (Redon, R. et al. Nature 444:444-54 (2006) and Estivill, X. & Armengol, L. PLoS Genetics 3:e90 (2007)). To date, known CNVs account for over 15% of the assembled human genome (Estivill, X. Armengol, L. PLoS Genetics 3:e90 (2007)). However, a majority of these variants are extremely rare and cover a small percentage of a human genome of any particular individual.

Today, it is estimated that one in every 110 children is diagnosed with Autism Spectrum Disorder (ASD), making it more common than childhood cancer, juvenile diabetes and pediatric AIDS combined. An estimated 1.5 million individuals in the U.S. and tens of millions worldwide are affected by autism. Government statistics suggest the prevalence rate of autism is increasing 10-17 percent annually. There is no established explanation for this increase, although improved screening and environmental influences are two reasons often considered. Studies suggest boys are more likely than girls to develop autism and receive the screening three to four times more frequently. Current estimates are that in the United States alone, one out of 70 boys is diagnosed with autism. ASD can be characterized by problems and symptoms in the following areas: communication, both verbal and non-verbal, such as pointing, eye contact, and smiling; social, such as sharing emotions, understanding how others think and feel, and holding a conversation; and routines or repetitive behaviors (also called stereotyped behaviors), such as repeating words or actions, obsessively following routines or schedules, and playing in repetitive ways. As genetic variations conferring risk to developmental disorders, including ASD, are uncovered, genetic testing can play a role for clinical therapeutics.

Despite these advances towards an understanding of the etiology of developmental disorders, a large fraction of the genetic contribution to these disorders remains undetermined. Identification of underlying genetic variants that can contribute to developmental disorder pathogenesis can aid in the screening and identification of individuals at risk of developing these disorders and can be useful for disease management. There is a need to identify new treatments for developmental disorders, specifically ASD, and the identification of novel genetic risk factors can assist in the development of potential therapeutics and agents. There is also a need for improved assays for predicting and determining potential treatments and their effectiveness.

SUMMARY OF THE INVENTION

An aspect of the invention includes a method of screening one or more subjects for at least one genetic variation that disrupts or modulates one or more genes in Tables 1-7, comprising: assaying at least one genetic sample obtained from each of the one or more subjects for the at least one genetic variation in one or more genes in Tables 1-7.

In some embodiments, at least one genetic variation is associated with a Pervasive Developmental Disorders (PDD) or a Pervasive Developmental Disorder-Not Otherwise Specified (PDD-NOS). In some embodiments, the at least one genetic variation is one encoded by SEQ ID NOs 1-643 or 2418-2557. In some embodiments, the at least one genetic variation comprises one or more point mutations, polymorphisms, translocations, insertions, deletions, amplifications, inversions, microsatellites, interstitial deletions, copy number variations (CNVs), or any combination thereof. In some embodiments, the at least one genetic variation comprises a loss of heterozygosity. In some embodiments, the at least one genetic variation disrupts or modulates one or more genomic sequences of SEQ ID NOs 644-2417 or 2558-2739. In some embodiments, the at least one genetic variation disrupts or modulates the expression or function of one or more RNA transcripts, one or more polypeptides, or a combination thereof, expressed from the one or more genomic sequences of SEQ ID NOs 644-2417 or 2558-2739.

In some embodiments, the assaying comprises detecting nucleic acid information from the at least one genetic sample. In some embodiments, the nucleic acid information is detected by one or more methods selected from the group comprising PCR, sequencing, Northern blots, or any combination thereof. In some embodiments, the sequencing comprises one or more high-throughput sequencing methods. In some embodiments, the one or more high throughput sequencing methods comprise Massively Parallel Signature Sequencing (MPSS), polony sequencing, 454 pyrosequencing, Illumina sequencing, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, or microfluidic Sanger sequencing. In some embodiments, the at least one genetic sample is collected from blood, saliva, urine, serum, tears, skin, tissue, or hair from the one or more subjects. In some embodiments, the assaying the at least one genetic sample of the one or more subjects comprises purifying nucleic acids from the at least one genetic sample. In some embodiments, the assaying the at least one genetic sample of the one or more subjects comprises amplifying at least one nucleotide sequence in the at least one genetic sample. In some embodiments, the assaying the at least one genetic sample for at least one genetic variation comprises a microarray analysis of the at least one genetic sample. In some embodiments, the microarray analysis comprises a CGH array analysis. In some embodiments, the CGH array detects the presence or absence of the at least one genetic variations.

In some embodiments, the method further comprises determining whether the one or more subjects has a Pervasive Developmental Disorders (PDD) or a Pervasive Developmental Disorder-Not Otherwise Specified (PDD-NOS), or an altered susceptibility to a PDD or PDD-NOS. In some embodiments, the one or more subjects were previously diagnosed or are suspected as having the PDD or PDD-NOS based on an evaluation by a psychologist, a neurologist, a psychiatrist, a speech therapist, or other professionals who screen subjects for a PDD or a PDD-NOS. In some embodiments, the determining comprises an evaluation of the one or more subject's communication, socialization, cognitive abilities, body movements, or a combination thereof. In some embodiments, the evaluation comprises observation, a questionnaire, a checklist, a test, or a combination thereof. In some embodiments, the evaluation comprises a Checklist of Autism in Toddlers (CHAT), a modified Checklist for Autism in Toddlers (M-CHAT), a Screening Tool for Autism in Two-Year-Olds (STAT), a Social Communication Questionnaire (SCQ) for children 4 years of age and older, an Autism Diagnosis Interview-Revised (ADI-R), an Autism Diagnostic Observation Schedule (ADOS), a Childhood Autism Rating Scale (CARS), an Autism Spectrum Screening Questionnaire (ASSQ), an Australian Scale for Asperger's Syndrome, a Childhood Asperger Syndrome Test (CAST), or a combination thereof. In some embodiments, the screening the one or more subjects further comprises selecting one or more therapies based on the presence or absence of the one or more genetic variations. In some embodiments, the assaying at least one genetic sample obtained from each of the one or more subjects comprises analyzing the whole genome or whole exome from the one or more subjects. In some embodiments, the nucleic acid information has already been obtained for the whole genome or whole exome from the one or more individuals and the nucleic acid information is obtained from in silico analysis.

In some embodiments, the PDD is Autism Spectrum Disorder (ASD). In some embodiments, the PDD-NOS is Asperger Syndrome, Rett Syndrome or Childhood Disintegrative Disorder. In some embodiments, the one or more subjects has at least one symptom of a PDD. In some embodiments, the PDD is ASD. In some embodiments, the at least one symptom comprises difficulty with verbal communication, difficulty using language, difficulty understanding language, difficulty with non-verbal communication, difficulty with social interaction, unusual ways of playing with toys and other objects, difficulty adjusting to changes in routine or familiar surroundings, repetitive body movements or patterns of behavior, changing response to sound, temper tantrums, difficulty sleeping, aggressive behavior, fearfulness or anxiety, or a combination thereof. In some embodiments, the at least one symptom comprises not babbling, pointing, or making meaningful gestures by 1 year of age, not speaking one word by 16 months of age, not combining two words by 2 years of age, not responding to their name, losing language, losing social skills, qualitative impairment in social interaction, impairments in the use of multiple nonverbal behaviors to regulate social interaction, failure to develop peer relationships appropriate to developmental level, not spontaneously seeking to share enjoyment or interests or achievements with other people, lacking social or emotional reciprocity, qualitative impairments in verbal communication, repetitive and stereotyped patterns of behavior and interests and activities, encompassing preoccupation with one or more stereotyped and restricted patterns of interest that is abnormal either in intensity or focus, apparently inflexible adherence to specific and nonfunctional routines or rituals, stereotyped and repetitive motor mannerisms, persistent preoccupation with parts of objects, abnormal functioning in symbolic or imaginative play, or a combination thereof. In some embodiments, the one or more subjects has at least one symptom of a PDD-NOS. In some embodiments, the at least one symptom of a PDD-NOS comprises qualitative impairment in social interaction, marked impairments in the use of multiple nonverbal behaviors to regulate social interaction, failure to develop peer relationships appropriate to developmental level, a lack of spontaneous seeking to share enjoyment or interest or achievements with other people lack of social or emotional reciprocity, restricted repetitive and stereotyped patterns of behavior or interests and activities, encompassing preoccupation with one or more stereotyped and restricted patterns of interest, nonfunctional routines or rituals, stereotyped and repetitive motor mannerisms, persistent preoccupation with parts of objects, clinically significant impairments in social or occupational or other important areas of functioning, deceleration of head growth between ages 5 and 48 months, loss of previously acquired purposeful hand skills between ages 5 and 30 months with the subsequent development of stereotyped hand movements, loss of social engagement early in the, appearance of poorly coordinated gait or trunk movements, severely impaired expressive and receptive language development with severe psychomotor retardation, clinically significant loss of previously acquired skills before age 10 years, impairment in nonverbal behaviors, failure to develop peer relationships, lack of social or emotional reciprocity, qualitative impairments in communication restricted or repetitive or and stereotyped patterns of behavior or interests and activities, or a combination thereof.

In some embodiments, the one or more subjects is human. In some embodiments, the one or more subjects is less than 12 years old, less than 8 years old, less than 6 years old, or less than 3 years.

An aspect of the invention includes a method of diagnosing one or more subjects for a PDD or a PDD-NOS, comprising: assaying at least one genetic sample of each of the one or more subjects for the presence or absence of at least one genetic variation in one or more genes in Tables 1-7.

In some embodiments, the at least one genetic variation is one encoded by SEQ ID NOs 1-643 or 2418-2557. In some embodiments, the one or ore subjects is diagnosed with the PDD or PDD-NOS if the at least one genetic variation is present. In some embodiments, the one or more subjects is not diagnosed with PDD or PDD-NOS if the at least one genetic variation is absent.

In some embodiments, the assaying comprises detecting nucleic acid information from the at least one genetic sample. In some embodiments, the nucleic acid information is detected by one or more methods selected from the group comprising PCR, sequencing, Northern blots, or any combination thereof. In some embodiments, the sequencing comprises one or more high-throughput sequencing methods. In some embodiments, the one or more high throughput sequencing methods comprise Massively Parallel Signature Sequencing (MPSS), polony sequencing, 454 pyrosequencing, Illumina sequencing, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, or microfluidic Sanger sequencing. In some embodiments, the method further comprises determining whether the one or more subjects has a PDD or PDD-NOS or an altered susceptibility to a PDD or PDD-NOS. In some embodiments, the one or more subjects were previously diagnosed or are suspected as having the PDD or PDD-NOS based on an evaluation by a psychologist, a neurologist, a psychiatrist, a speech therapist, or other professionals who screen subjects for a PDD or a PDD-NOS.

In some embodiments, the determining comprises an evaluation of the one or more subject's communication, socialization, cognitive abilities, body movements, or a combination thereof. In some embodiments, the evaluation comprises an evaluation of the one or more subject's communication, socialization, cognitive abilities, body movements, or a combination thereof. In some embodiments, the evaluation comprises observation, a questionnaire, a checklist, a test, or a combination thereof. In some embodiments, the evaluation comprises a Checklist of Autism in Toddlers (CHAT), a modified Checklist for Autism in Toddlers (M-CHAT), a Screening Tool for Autism in Two-Year-Olds (STAT), a Social Communication Questionnaire (SCQ) for children 4 years of age and older, an Autism Diagnosis Interview-Revised (ADI-R), an Autism Diagnostic Observation Schedule (ADOS), a Childhood Autism Rating Scale (CARS), an Autism Spectrum Screening Questionnaire (ASSQ), an Australian Scale for Asperger's Syndrome, a Childhood Asperger Syndrome Test (CAST), or a combination thereof. In some embodiments, the determining comprises comparing the nucleic acid information to those of one or more other subjects.

In some embodiments, the one more subjects comprise one or more subjects not suspected of having the PDD or the PDD-NOS. In some embodiments, the one or more other subjects comprise one or more subjects suspected of having the PDD or the PDD-NOS. In some embodiments, one or more subjects comprise one or more subjects with the PDD or the PDD-NOS. In some embodiments, the one or more other subjects comprise one or more subjects without the PDD or the PDD-NOS. In some embodiments, the one or more subjects comprise one or more subjects who are symptomatic for the PDD or the PDD-NOS. In some embodiments, the one or more other subjects comprise one or more subjects who are asymptomatic for the PDD or the PDD-NOS. In some embodiments, the one or more subjects comprise one or more subjects that have an increased susceptibility to the PDD or the PDD-NOS. In some embodiments, the one or more subjects comprise one or more subjects that have a decreased susceptibility to the PDD or the PDD-NOS. In some embodiments, the one or more subjects comprise one or more subjects receiving a treatment, therapeutic regimen, or any combination thereof for a PDD or PDD-NOS.

In some embodiments, determining whether the one or more subjects have the PDD or the PDD-NOS or an altered susceptibility to the PDD or the PDD-NOS comprises analyzing at least one behavioral analysis of the one or more subjects and the nucleic acid sequence information of the one or more subjects, or a combination thereof.

In some embodiments, the at least one genetic sample is collected from blood, saliva, urine, serum, tears, skin, tissue, or hair from the one or more subjects. In some embodiments, the assaying the at least one genetic sample of the one or more subjects comprises purifying nucleic acids from the at least one genetic sample. In some embodiments, the assaying the at least one genetic sample of the one or more subjects comprises amplifying at least one nucleotide sequence in the at least one genetic sample. In some embodiments, the assaying the at least one genetic sample for at least one genetic variation comprises a microarray analysis of the at least one genetic sample. In some embodiments, the microarray analysis comprises a CGH array analysis. In some embodiments, the CGH array detects the presence or absence of the at least one genetic variations. In some embodiments, the at least one genetic variation comprises one or more point mutations, polymorphisms, translocations, insertions, deletions, amplifications, inversions, microsatellites, interstitial deletions, copy number variations (CNVs), or any combination thereof. In some embodiments, the at least one genetic variation comprises a loss of heterozygosity. In some embodiments, the at least one genetic variation disrupts or modulates one or more genomic sequences of SEQ ID NOs 644-2417 or 2558-2739. In some embodiments, the at least one genetic variation disrupts or modulates the expression or function of one or more RNA transcripts from the one or more genomic sequences of SEQ ID NOs 644-2417 or 2558-2739.

In some embodiments, the assaying at least one genetic sample obtained from each of the one or more subjects comprises analyzing the whole genome or whole exome from the one or more subjects. In some embodiments, the nucleic acid information has already been obtained for the whole genome or whole exome from the one or more individuals and the nucleic acid information is obtained from in silico analysis. In some embodiments, the method further comprises selecting one or more therapies based on the presence or absence of the one or more genetic variations.

In some embodiments, the PDD is ASD. In some embodiments, the PDD-NOS is Asperger Syndrome, Rett Syndrome or Childhood Disintegrative Disorder. In some embodiments, the one or more subjects has at least one symptom of a PDD. In some embodiments, the PDD is ASD. In some embodiments, the at least one symptom comprises difficulty with verbal communication, difficulty using language, difficulty understanding language, difficulty with non-verbal communication, difficulty with social interaction, unusual ways of playing with toys and other objects, difficulty adjusting to changes in routine or familiar surroundings, repetitive body movements or patterns of behavior, changing response to sound, temper tantrums, difficulty sleeping, aggressive behavior, fearfulness or anxiety, or a combination thereof. In some embodiments, the at least one symptom comprises not babbling, pointing, or making meaningful gestures by 1 year of age, not speaking one word by 16 months of age, not combining two words by 2 years of age, not responding to their name, losing language, losing social skills, qualitative impairment in social interaction, impairments in the use of multiple nonverbal behaviors to regulate social interaction, failure to develop peer relationships appropriate to developmental level, not spontaneously seeking to share enjoyment or interests or achievements with other people, lacking social or emotional reciprocity, qualitative impairments in verbal communication, repetitive and stereotyped patterns of behavior and interests and activities, encompassing preoccupation with one or more stereotyped and restricted patterns of interest that is abnormal either in intensity or focus, apparently inflexible adherence to specific and nonfunctional routines or rituals, stereotyped and repetitive motor mannerisms, persistent preoccupation with parts of objects, abnormal functioning in symbolic or imaginative play, or a combination thereof. In some embodiments, the one or more subjects has at least one symptom of a PDD-NOS. In some embodiments, the at least one symptom of a PDD-NOS comprises qualitative impairment in social interaction, marked impairments in the use of multiple nonverbal behaviors to regulate social interaction, failure to develop peer relationships appropriate to developmental level, a lack of spontaneous seeking to share enjoyment or interest or achievements with other people lack of social or emotional reciprocity, restricted repetitive and stereotyped patterns of behavior or interests and activities, encompassing preoccupation with one or more stereotyped and restricted patterns of interest, nonfunctional routines or rituals, stereotyped and repetitive motor mannerisms, persistent preoccupation with parts of objects, clinically significant impairments in social or occupational or other important areas of functioning, deceleration of head growth between ages 5 and 48 months, loss of previously acquired purposeful hand skills between ages 5 and 30 months with the subsequent development of stereotyped hand movements, loss of social engagement early in the, appearance of poorly coordinated gait or trunk movements, severely impaired expressive and receptive language development with severe psychomotor retardation, clinically significant loss of previously acquired skills before age 10 years, impairment in nonverbal behaviors, failure to develop peer relationships, lack of social or emotional reciprocity, qualitative impairments in communication restricted or repetitive or and stereotyped patterns of behavior or interests and activities, or a combination thereof.

In some embodiments, the one or more subjects is human. In some embodiments, the one or more subjects is less than 12 years old, less than 8 years old, less than 6 years old, or less than 3 years.

One aspect of the invention includes a method of screening for a therapeutic agent for treatment of a PDD or a PDD-NOS, comprising identifying an agent that disrupts or modulates one or more genomic sequences of SEQ ID NOs 644-2417 or 2558-2739 or one or more expression products thereof.

In some embodiments, the one or more expression products comprise one or more RNA transcripts. In some embodiments, the one or more RNA transcripts comprise one or more RNA transcripts of Tables 4 and/or 7. In some embodiments, the one or more expression products comprise one or more polypeptides. In some embodiments, the one or more polypeptides are translated from one or more RNA transcripts of Tables 4 and/or 7. In some embodiments, disrupting or modulating the one or more genomic sequences of SEQ ID NOs 644-2417 or 2558-2739 or expression products thereof, comprises an increase in expression of the one or more expression products. In some embodiments, disrupting or modulating the one or more genomic sequences of SEQ ID NOs 644-2417 or 2558-2739 or expression products thereof, comprises a decrease in expression of the one or more expression products.

An aspect of the invention includes a method of treating a subject for a PDD or a PDD-NOS, comprising administering one or more agents to disrupt or modulate one or more genomic sequences of SEQ ID NOs 644-2417 or 2558-2739 or one or more expression products thereof, thereby treating the PDD or the PDD-NOS.

In some embodiments, the one or more expression products comprise one or more RNA transcripts. In some embodiments, the one or more RNA transcripts comprise one or more RNA transcripts of Tables 4 and/or 7. In some embodiments, the one or more expression products comprise one or more polypeptides. In some embodiments, the one or more polypeptides are translated from one or more RNA transcripts of Tables 4 and/or 7. In some embodiments, the one or more agents are selected from the group comprising: an antibody, a drug, a combination of drugs, a compound, a combination of compounds, radiation, a genetic sequence, a combination of genetic sequences, heat, cryogenics, and a combination of two or more of any combination thereof.

In some embodiments, the PDD is ASD. In some embodiments, the PDD-NOS is Asperger Syndrome, Rett Syndrome or Childhood Disintegrative Disorder. In some embodiments, the one or more subjects has at least one symptom of a PDD. In some embodiments, the PDD is ASD. In some embodiments, the at least one symptom comprises difficulty with verbal communication, difficulty using language, difficulty understanding language, difficulty with non-verbal communication, difficulty with social interaction, unusual ways of playing with toys and other objects, difficulty adjusting to changes in routine or familiar surroundings, repetitive body movements or patterns of behavior, changing response to sound, temper tantrums, difficulty sleeping, aggressive behavior, fearfulness or anxiety, or a combination thereof. In some embodiments, the at least one symptom comprises not babbling, pointing, or making meaningful gestures by 1 year of age, not speaking one word by 16 months of age, not combining two words by 2 years of age, not responding to their name, losing language, losing social skills, qualitative impairment in social interaction, impairments in the use of multiple nonverbal behaviors to regulate social interaction, failure to develop peer relationships appropriate to developmental level, not spontaneously seeking to share enjoyment or interests or achievements with other people, lacking social or emotional reciprocity, qualitative impairments in verbal communication, repetitive and stereotyped patterns of behavior and interests and activities, encompassing preoccupation with one or more stereotyped and restricted patterns of interest that is abnormal either in intensity or focus, apparently inflexible adherence to specific and nonfunctional routines or rituals, stereotyped and repetitive motor mannerisms, persistent preoccupation with parts of objects, abnormal functioning in symbolic or imaginative play, or a combination thereof. In some embodiments, the one or more subjects has at least one symptom of a PDD-NOS. In some embodiments, the at least one symptom of a PDD-NOS comprises qualitative impairment in social interaction, marked impairments in the use of multiple nonverbal behaviors to regulate social interaction, failure to develop peer relationships appropriate to developmental level, a lack of spontaneous seeking to share enjoyment or interest or achievements with other people lack of social or emotional reciprocity, restricted repetitive and stereotyped patterns of behavior or interests and activities, encompassing preoccupation with one or more stereotyped and restricted patterns of interest, nonfunctional routines or rituals, stereotyped and repetitive motor mannerisms, persistent preoccupation with parts of objects, clinically significant impairments in social or occupational or other important areas of functioning, deceleration of head growth between ages 5 and 48 months, loss of previously acquired purposeful hand skills between ages 5 and 30 months with the subsequent development of stereotyped hand movements, loss of social engagement early in the, appearance of poorly coordinated gait or trunk movements, severely impaired expressive and receptive language development with severe psychomotor retardation, clinically significant loss of previously acquired skills before age 10 years, impairment in nonverbal behaviors, failure to develop peer relationships, lack of social or emotional reciprocity, qualitative impairments in communication restricted or repetitive or and stereotyped patterns of behavior or interests and activities, or a combination thereof.

In some embodiments, the one or more subjects is human. In some embodiments, the one or more subjects is less than 12 years old, less than 8 years old, less than 6 years old, or less than 3 years.

An aspect of the invention includes a kit for screening for a PDD or PDD-NOS in one or more subjects, the kit comprising reagents for assaying a genetic sample from the one or more subjects for the presence of at least one genetic variation encoded by SEQ ID NOs 1-643 or 2418-2557.

In some embodiments, the at least one genetic variation disrupts or modulates one or more genomic sequences of SEQ ID NOs 644-2417 or 2558-2739, or one or more expression products thereof. In some embodiments, the one or more expression products comprise one or more RNA transcripts. In some embodiments, the one or more RNA transcripts comprise one or more RNA transcripts of Tables 4 and/or 7. In some embodiments, the one or more expression products comprise one or more polypeptides. In some embodiments, the one or more polypeptides are translated from one or more RNA transcripts of Tables 4 and/or 7.

In some embodiments, the reagents comprise nucleic acid probes. In some embodiments, the reagents comprise oligonucleotides. In some embodiments, the reagents comprise primers.

In some embodiments, the PDD is ASD. In some embodiments, the PDD-NOS is Asperger Syndrome, Rett Syndrome or Childhood Disintegrative Disorder. In some embodiments, the one or more subjects has at least one symptom of a PDD. In some embodiments, the PDD is ASD. In some embodiments, the one or more subjects has at least one symptom of a PDD-NOS.

In some embodiments, the one or more subjects is human. In some embodiments, the one or more subjects is less than 12 years old, less than 8 years old, less than 6 years old, or less than 3 years.

An aspect of the invention includes an isolated polynucleotide sequence or fragment thereof, comprising at least 60% identity to any of polynucleotide sequence of SEQ ID NOs 1 to 2739.

In some embodiments, the isolated polynucleotide sequence comprises at least 70% identity to any of polynucleotide sequence of SEQ ID NOs 1 to 2739. In some embodiments, the isolated polynucleotide sequence comprises at least 80% identity to any of polynucleotide sequence of SEQ ID NOs 1 to 2739. In some embodiments, the isolated polynucleotide sequence comprises at least 90% identity to any of polynucleotide sequence of SEQ ID NOs 1 to 2739.

An aspect of the invention includes an isolated polynucleotide sequence comprising at least 60% identity to a compliment of any of polynucleotide sequence of SEQ ID NOs 1 to 2739.

In some embodiments, the isolated polynucleotide sequence comprises at least 70% identity to a compliment of any of polynucleotide sequence of SEQ ID NOs 1 to 2739. In some embodiments, the isolated polynucleotide sequence comprises at least 80% identity to a compliment of any of polynucleotide sequence of SEQ ID NOs 1 to 2739. In some embodiments, the isolated polynucleotide sequence comprises at least 90% identity to a compliment of any of polynucleotide sequence of SEQ ID NOs 1 to 2739. In some embodiments, the isolated polynucleotide sequence comprises the polynucleotide sequence comprises any of a CNV of SEQ ID NOs 1-643 or 2418-2557. In some embodiments, the isolated polynucleotide sequence comprises any of a genomic sequence of SEQ ID NOs 644-2417 or 2558-2739. In some embodiments, the isolated polynucleotide sequence comprises an RNA sequence transcribed from a genomic sequence of SEQ ID NOs 644-2417 or 2558-2739. In some embodiments, the isolated polynucleotide sequence comprises any of a genetic variation not present in the human genome.

An aspect of the invention includes an isolated polypeptide encoded by an RNA sequence transcribed from any of genomic sequence of SEQ ID NOs 644-2417 or 2558-2739.

An aspect of the invention includes a host cell comprising an expression control sequence operably linked to a polynucleotide selected from the group consisting of any of polynucleotide sequence of SEQ ID Nos 644-2417 or 2558-2739, or a fragment thereof.

In some embodiments, the expression control sequence is non-native to the host cell. In some embodiments, the expression control sequence is native to the host cell.

An aspect of the invention includes a method for identifying an agent having a therapeutic benefit for treatment of a PDD or a PDD-NOS, comprising: a) providing cells comprising at least one genetic variation of SEQ ID NOs 1-643 or 2418-2557; b) contacting the cells of step a) with a test agent and c) analyzing whether the agent has a therapeutic benefit for treatment of the PDD or the PDD-NOS of step a), thereby identifying agents which have a therapeutic benefit for treatment of the PDD or the PDD-NOS.

In some embodiments, the method further comprises: d) providing cells which do not comprise at least one genetic variation of SEQ ID NOs 1-643 or 2418-2557; e) contacting the cells of steps a) and d) with a test agent; and f) analyzing whether the agent has a therapeutic benefit for treatment of the PDD or the PDD-NOS of step a) relative to those of step b), thereby identifying agents which have a therapeutic benefit for treatment of the PDD or the PDD-NOS. In some embodiments, the therapeutic agent has efficacy for the treatment of a PDD or a PDD-NOS.

An aspect of the invention includes a therapeutic agent identified by any of the methods described herein.

An aspect of the invention includes a panel of biomarkers for a PDD or a PDD-NOS comprising one or more genes contained in the one or more polynucleotide sequences selected from SEQ ID NOs 644-2417 or 2558-2739.

In some embodiments, the panel comprises two or more genes contained in the one or more polynucleotide sequences selected from SEQ ID NOs 644-2417 or 2558-2739. In some embodiments, the panel comprises at least 5, 10, 25, 50, 100 or 200 genes contained in the one or more polynucleotide sequences selected from SEQ ID NOs 644-2417 or 2558-2739. In some embodiments, at least one of the polynucleotide sequences is a fragment of the one or more polynucleotide sequences selected from SEQ ID NOs 644-2417 or 2558-2739. In some embodiments, at least one of the polynucleotide sequences is a variant of the one or more polynucleotide sequences selected from SEQ ID NOs 644-2417 or 2558-2739. In some embodiments, the panel is selected for analysis of polynucleotide expression levels for a PDD or a PDD-NOS. In some embodiments, the polynucleotide expression levels are mRNA expression levels. In some embodiments, the panel is used in the management of patient care for a PDD or a PDD-NOS, wherein the management of patient care includes one or more of risk assessment, early diagnosis, prognosis establishment, patient treatment monitoring, and treatment efficacy detection. In some embodiments, the panel is used in discovery of therapeutic intervention of a PDD or a PDD-NOS.

An aspect of the invention includes a method for measuring expression levels of polynucleotide sequences from biomarkers for a PDD or a PDD-NOS in a subject, comprising: a) selecting a panel of biomarkers comprising two or more genes contained in one or more polynucleotide sequences selected from SEQ ID Nos 644-2417 or 2558-2739; b) isolating cellular RNA from a sample obtained from the subject; c) synthesizing cDNA from the cellular RNA for each biomarker in the panel using suitable primers; d) optionally amplifying the cDNA; and e) quantifying levels of the cDNA from the sample.

In some embodiments, the step of selecting a panel of biomarkers comprises at least 5, 10, 25, 50, 100 or 200 genes contained in one or more polynucleotide sequences selected from SEQ ID NOs 644-2417 or 2558-2739. In some embodiments, the step of quantifying the levels of cDNA further comprises labeling cDNA. In some embodiments, labeling cDNA comprises labeling with at least one chromophore. In some embodiments, the cDNA levels for the sample are compared to a control cDNA level. In some embodiments, the comparison is used in the management of patient care in PDD or PDD-NOS. In some embodiments, the management of patient care includes one or more of risk assessment, early diagnosis, establishing prognosis, monitoring patient treatment, and detecting treatment efficacy. In some embodiments, the comparison is used in discovery of therapeutic intervention of PDD or PDD-NOS.

An aspect of the invention includes a method for measuring expression levels of polypeptides comprising: a) selecting a panel of biomarkers comprising at least two polypeptides encoded by an RNA sequence transcribed from a genomic sequence of SEQ ID Nos 644-2417 or 2558-2739; b) obtaining a biological sample; c) creating an antibody panel for each biomarker in the panel; d) using the antibody panel to bind the polypeptides from the sample; and e) quantifying levels of the polypeptides bound from the sample to the antibody panel.

In some embodiments, the polypeptide levels of the biological sample are increased or decreased compared to the polypeptide levels of a control biological sample. In some embodiments, the subject is treated for a PDD or PDD-NOS patient based on the quantified levels of the polypeptides bound from the sample to the antibody panel. In some embodiments, the treatment of a subject includes one or more of risk assessment, early diagnosis, establishing prognosis, monitoring patient treatment, and detecting treatment efficacy. In some embodiments, the comparison is used in discovery of a therapeutic intervention of a PDD or PDD-NOS.

An aspect of the invention includes a kit for the determination of PDD or PDD-NOS comprising: at least one reagent that is used in analysis of one or more polynucleotide expression levels for a panel of biomarkers for PDD or PDD-NOS, wherein the panel comprises two or more genes contained in one or more polynucleotide sequences selected from SEQ ID NOs 644-2417 or 2558-2739, and instructions for using the kit for analyzing the expression levels.

In some embodiments, the one or more polynucleotide expression levels comprise one or more RNA transcript expression levels. In some embodiments, the one or more RNA transcript expression levels correspond to one or more RNA transcripts of Tables 4 and/or 7. In some embodiments, the at least one reagent comprises at least two sets of suitable primers. In some embodiments, the at least one reagent comprises a reagent for the preparation of cDNA. In some embodiments, the at least one reagent comprises a reagent that is used for detection and quantization of polynucleotides. In some embodiments, the at least one reagent comprises at least one chromophore.

An aspect of the invention includes a kit for the determination of PDD or PDD-NOS comprising: at least one reagent that is used in analysis of polypeptide expression levels for a panel of biomarkers for PDD or PDD-NOS, wherein the panel comprises at least two polypeptides expressed from two or more genes contained in one or more polynucleotide sequences selected from SEQ ID NOs 644-2417 or 2558-2739; and instructions for using the kit for analyzing the expression levels.

In some embodiments, the reagent is an antibody reagent that binds a polypeptide selected in the panel. In some embodiments, the kit further comprises a reagent that is used for detection of a bound polypeptide. In some embodiments, the reagent includes a second antibody.

An aspect of the invention includes a method of screening a subject for a PDD or PDD-NOS, the method comprising: a) assaying a nucleic acid sample obtained from the subject by PCR, array Comparative Genomic Hybridization, sequencing, SNP genotyping, or Fluorescence in Situ Hybridization to detect sequence information for more than one genetic loci; b) comparing the sequence information to a panel of nucleic acid biomarkers, wherein the panel comprises at least one nucleic acid biomarker for each of the more than one genetic loci; and wherein the panel comprises at least 2 low frequency nucleic acid biomarkers, wherein the low frequency nucleic acid biomarkers occur at a frequency of 0.1% or less in a population of subjects without a diagnosis of the PDD or PDD-NOS; and c) screening the subject for the presence or absence of the PDD or the PDD-NOS if one or more of the low frequency biomarkers in the panel are present in the sequence information.

In some embodiments, the panel comprises at least 5, 10, 25, 50, 100 or 200 low frequency nucleic acid biomarkers. In some embodiments, the presence or absence of the PDD or the PDD-NOS in the subject is determined with at least 50% confidence. In some embodiments, the low frequency biomarkers occur at a frequency of 0.01% or less, 0.001% or less, or 0.0001% or less in a population of subjects without a diagnosis of the PDD or the PDD-NOS. In some embodiments, the panel of nucleic acid biomarkers comprises at least two genes contained in the one or more polynucleotide sequences selected from SEQ ID NOs 644-2417 or 2558-2739. In some embodiments, the PDD is ASD.

In some embodiments, the PDD-NOS is Asperger Syndrome, Rett Syndrome or Childhood Disintegrative Disorder. In some embodiments, the method further comprises identifying a therapeutic agent useful for treating the PDD or the PDD-NOS. In some embodiments, the method further comprises administering one or more of the therapeutic agents to the subject if one or more of the low frequency biomarkers in the panel are present in the sequence information.

An aspect of the invention includes a kit for screening a subject for a PDD or a PDD-NOS, the kit comprising at least one reagent for assaying a nucleic acid sample from the subject for information on a panel of nucleic acid biomarkers, wherein the panel comprises at least 2 low frequency biomarkers, and wherein the low frequency biomarkers occur at a frequency of 0.1% or less in a population of subjects without a diagnosis of the PDD or the PDD-NOS.

In some embodiments, a presence or absence of the PDD or the PDD-NOS in the subject is determined with a 50% confidence. In some embodiments, the panel comprises at least 5, 10, 25, 50, 100 or 200 low frequency nucleic acid biomarkers. In some embodiments, the low frequency biomarkers occur at a frequency of 0.01% or less, 0.001% or less, or 0.0001% or less in a population of subjects without a diagnosis of the PDD or PDD-NOS. In some embodiments, the panel of nucleic acid biomarkers comprises at least two genes contained in the one or more polynucleotide sequences selected from SEQ ID NOs 644-2417 or 2558-2739. In some embodiments, the at least one reagent comprises at least two sets of suitable primers. In some embodiments, the at least one reagent comprises a reagent for the preparation of cDNA. In some embodiments, the at least one reagent comprises a reagent that is used for detection and quantization of polynucleotides. In some embodiments, the at least one reagent comprises at least one chromophore.

An aspect of the invention includes a method of generating a panel of nucleic acid biomarkers comprising: a) assaying a nucleic acid sample from a first population of subjects by PCR, array Comparative Genomic Hybridization, sequencing, SNP genotyping, or Fluorescence in Situ Hybridization for nucleic acid sequence information, wherein the subjects of the first population have a diagnosis of a PDD or a PDD-NOS. b) assaying a nucleic acid sample from a second population of subjects by PCR, array Comparative Genomic Hybridization, sequencing, SNP genotyping, or Fluorescence in Situ Hybridization for nucleic acid sequence information, wherein the subjects of the second population are without a diagnosis of a PDD or a PDD-NOS; c) comparing the nucleic acid sequence information from step (a) to that of step (b); d) determining the frequency of one or more biomarkers from the comparing step; and e) generating the panel of a nucleic acid biomarkers, wherein the panel comprises at least 2 low frequency biomarkers, and wherein the low frequency biomarkers occur at a frequency of 0.1% or less in a population of subjects without a diagnosis of a PDD or a PDD-NOS.

In some embodiments, the subjects in the second population of subjects without a diagnosis of a PDD or a PDD-NOS comprise one or more subjects not suspected of having the PDD or the PDD-NOS. In some embodiments, the subjects in the second population of subjects without a diagnosis of a PDD or a PDD-NOS comprise one or more subjects without the PDD or the PDD-NOS. In some embodiments, the subjects in the second population of subjects without a diagnosis of a PDD or a PDD-NOS comprise one or more subjects who are asymptomatic for the PDD or the PDD-NOS. In some embodiments, the subjects in the second population of subjects without a diagnosis of a PDD or a PDD-NOS comprise one or more subjects who have decreased susceptibility to the PDD or the PDD-NOS. In some embodiments, the subjects in the second population of subjects without a diagnosis of a PDD or a PDD-NOS comprise one or more subjects who are unassociated with a treatment, therapeutic regimen, or any combination thereof. In some embodiments, the panel comprises at least 5, 10, 25, 50, 100 or 200 low frequency nucleic acid biomarkers. In some embodiments, the low frequency biomarkers occur at a frequency of 0.01% or less, 0.001% or less, or 0.0001% or less in the second population of subjects without a diagnosis of a PDD or a PDD-NOS. In some embodiments, the panel of nucleic acid biomarkers comprises at least two genes contained in the one or more polynucleotide sequences selected from SEQ ID NOs 644-2417 or 2558-2739.

An aspect of the invention includes an array comprising a plurality of nucleic acid probes, wherein each probe comprises a sequence complimentary to a target sequence of one of the polynucleotide sequences selected from SEQ ID NOs 644-2417 or 2558-2739, or a fragment thereof. In some embodiments, the plurality of nucleic acid probes comprises at least 5, 10, 25, 50, 100 or 200 of the nucleic acid probes. In some embodiments, the array further comprises a second plurality of nucleic acid probes, wherein each probe in the second plurality of nucleic acid probes comprises a sequence complimentary to a complimentary target sequence of one of the polynucleotide sequences selected from SEQ ID NOs 1-643 or 2418-2557, or a fragment thereof. In some embodiments, second plurality of nucleic acid probes comprises at least 5, 10, 25, 50, 100 or 200 nucleic acid probes. In some embodiments, each different nucleic acid probe is attached to a bead. In some embodiments, each different nucleic acid probe is labeled with a detectable label. In some embodiments, each different nucleic acid probe is attached to a solid support in a determinable location of the array. In some embodiments, the solid support comprises plastics, glass, beads, microparticles, microtitre dishes, or gels. In some embodiments, the array further comprises control probes.

INCORPORATION BY REFERENCE

All publications, patents, and patent applications mentioned in this specification are herein incorporated by reference to the same extent as if each individual publication, patent, or patent application was specifically and individually indicated to be incorporated by reference. In the event of a conflict between a term herein and a term incorporated by reference, the term herein controls.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings.

DETAILED DESCRIPTION OF THE DISCLOSURE

Figure 1:
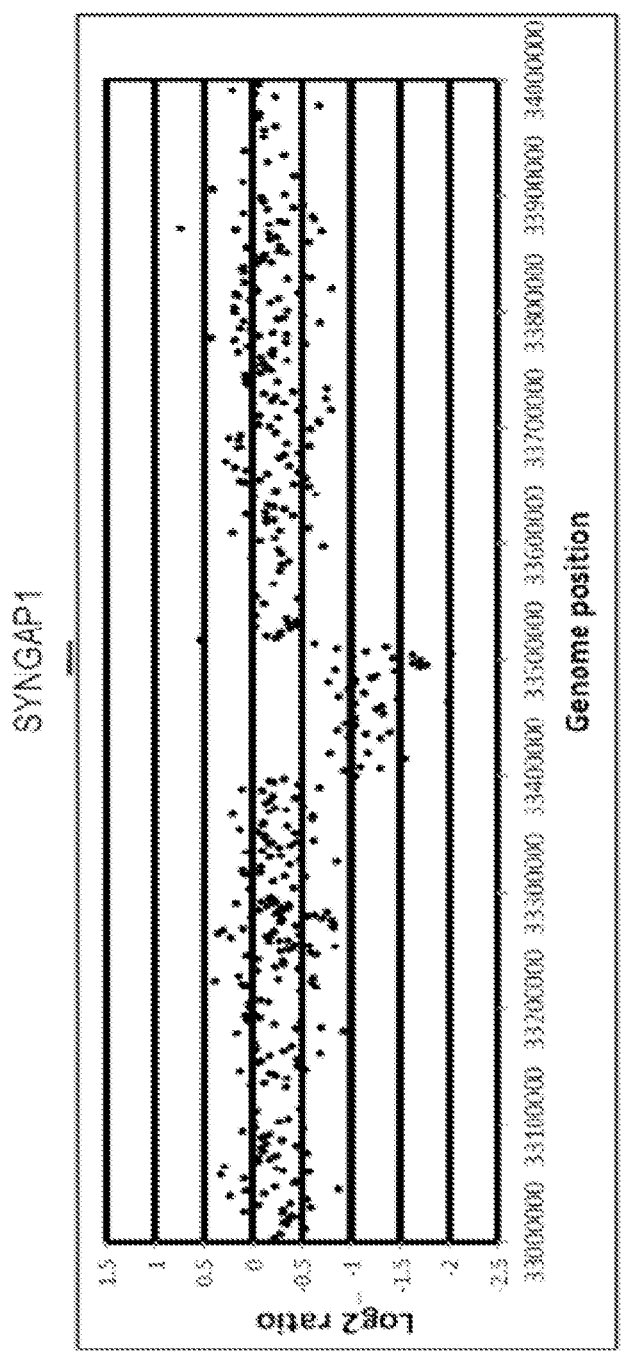
FIG. 1 depicts a log 2 ratio plot of CGH probe data showing a deletion impacting the SYNGAP1 gene (gray bar located at chr6:33400195-33511247) in an individual with ASD. See Table 1 for other deletions (11-111 Kb size range) impacting SYNGAP1 that are present in other ASD patients (10 of 682 ASD patients and 0 of 1005 controls. The overall OR for this gene was calculated to be 14.9).
Figure 2:
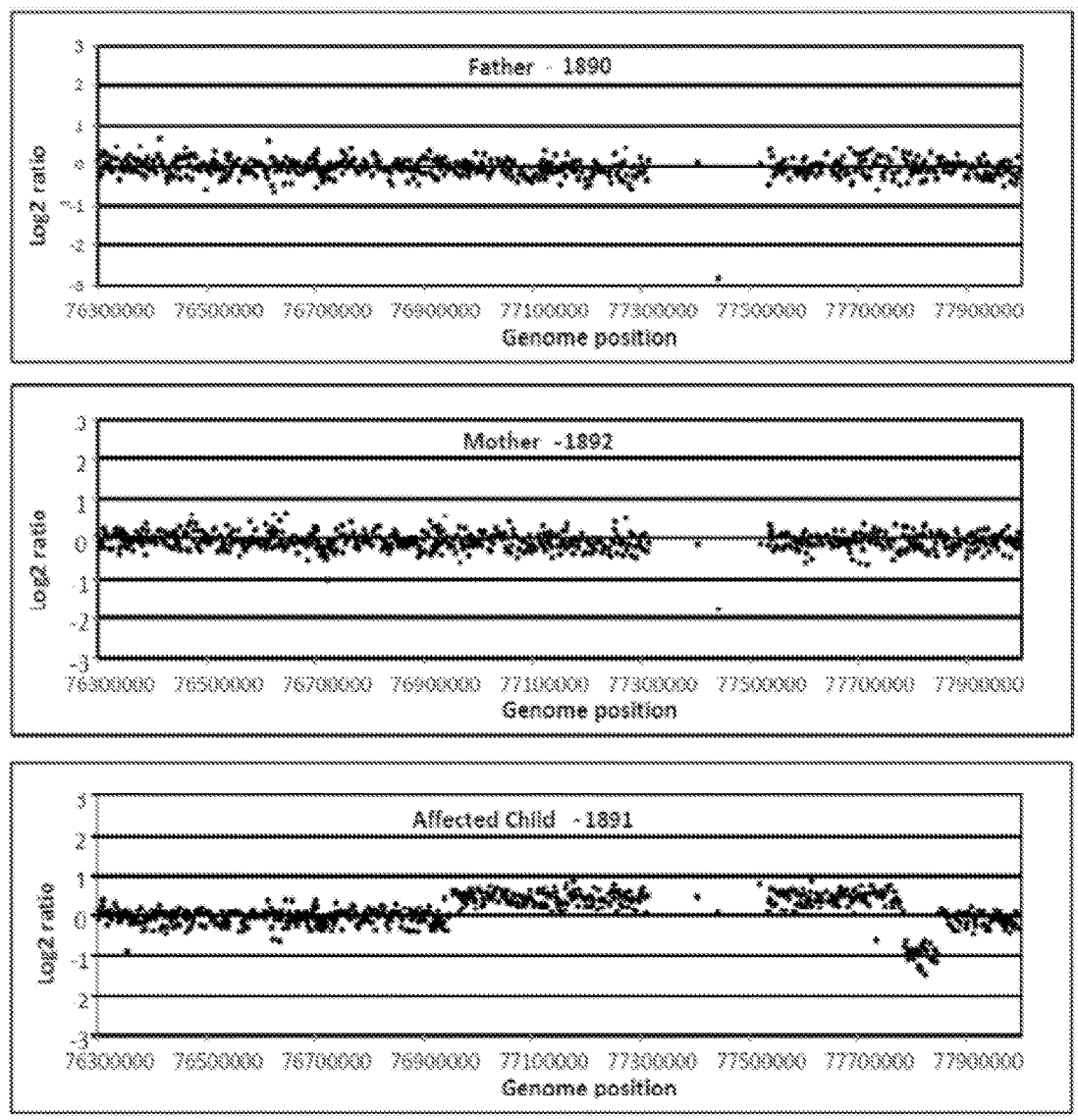
FIG. 2 depicts log 2 ratio plots of CGH probe data (chr17:76.3-78.0 Mb) for 2 unaffected parents (top and middle panel) and one male child with ASD (bottom panel). The child has a de novo complex rearrangement, resulting in a large duplication (chr17:76954271-77777066, size 822,795 bp) and a smaller deletion (chr17:77787243-77847938, size 60,695 bp), as detailed in Table 1.

The details of one or more inventive embodiments are set forth in the accompanying drawings, the claims, and in the description herein. Other features, objects, and advantages of inventive embodiments disclosed and contemplated herein will be apparent from the description and drawings, and from the claims. As used herein, unless otherwise indicated, the article "a" means one or more unless explicitly otherwise provided for. As used herein, unless otherwise indicated, terms such as "contain," "containing," "include," "including," and the like mean "comprising." As used herein, unless otherwise indicated, the term "or" can be conjunctive or disjunctive. As used herein, unless otherwise indicated, any embodiment can be combined with any other embodiment. As used herein, unless otherwise indicated, some inventive embodiments herein contemplate numerical ranges. When ranges are present, the ranges include the range endpoints. Additionally, every subrange and value within the range is present as if explicitly written out.

Described herein are methods of identifying variations in nucleic acids and genes associated with one or more developmental conditions. Described herein are methods of screening for determining a subject's susceptibility to developing or having, one or more developmental disorders, for example, Autism Spectrum Disorder (ASD), based on identification and detection of genetic nucleic acid variations. Also described herein, are methods and compositions for treating and/or preventing one or more developmental conditions using a therapeutic modality. The present disclosure encompasses methods of assessing an individual for probability of response to a therapeutic agent for a developmental disorder, methods for predicting the effectiveness of a therapeutic agent for a developmental disorder, nucleic acids, polypeptides and antibodies and computer-implemented functions. Kits for screening a sample from a subject to detect or determine susceptibility to a developmental disorder are also encompassed by the disclosure.

Genetic Variations Associated with Developmental Disorders

Genomic sequences within populations exhibit variability between individuals at many locations in the genome. For example, the human genome exhibits sequence variations that occur on average every 1,000 base pairs. Such genetic variations in nucleic acid sequences are commonly referred to as polymorphisms or polymorphic sites. In some embodiments, these genetic variations can be found to be associated with one or more disorders and/or diseases using the methods disclosed herein. In some embodiments the one or more disorders and/or diseases comprise one or more developmental disorders. In some embodiments the one or more developmental disorders comprise one or more Pervasive Developmental Disorders (PDD). In some embodiments, the one or more PDDs comprise ASD. ASD can refer to autism. In another embodiment, the one or more developmental disorders comprise Pervasive Developmental Disorder-Not Otherwise Specified (PDD-NOS). In some embodiments, PDD-NOS can comprise Asperger Syndrome, Rett Syndrome, fragile X syndrome and/or Childhood Disintegrative Disorder. In some embodiments genetic variations can be associated with one or more PDDs. In some embodiments genetic variations can be associated with one or more PDD-NOSs.

Scientific evidence suggests there is a potential for various combinations of factors causing ASD, such as multiple genetic variations that may cause autism on their own or when combined with exposure to as yet undetermined environmental factors. Timing of exposure during the child's development, such as before, during, or after birth, may also play a role in the development or final presentation of the disorder. A small number of cases can be linked to genetic disorders such as Fragile X, Tuberous Sclerosis, and Angelman's Syndrome, as well as exposure to environmental agents such as infectious ones (maternal rubella or cytomegalovirus) or chemical ones (thalidomide or valproate) during pregnancy.

In some embodiments, these genetic variations comprise point mutations, polymorphisms, translocations, insertions, deletions, amplifications, inversions, interstitial deletions, copy number variations (CNVs), loss of heterozygosity, or any combination thereof. In some embodiments polymorphisms (e.g. polymorphic markers), can comprise any nucleotide position at which two or more sequences are possible in a subject population. In some embodiments, each version of a nucleotide sequence with respect to the polymorphism can represent a specific allele, of the polymorphism. In some embodiments, genomic DNA from a subject can contain two alleles for any given polymorphic marker, representative of each copy of the marker on each chromosome. In some embodiments, an allele can be a nucleotide sequence of a given location on a chromosome. Polymorphisms can comprise any number of specific alleles. In some embodiments of the disclosure, a polymorphism can be characterized by the presence of two or more alleles in a population. In some embodiments, the polymorphism can be characterized by the presence of three or more alleles. In some embodiments, the polymorphism can be characterized by four or more alleles, five or more alleles, six or more alleles, seven or more alleles, nine or more alleles, or ten or more alleles. In some embodiments an allele can be associated with one or more diseases or disorders, for example, a developmental disorder risk allele can be an allele that is associated with increased or decreased risk of developing a developmental disorder. In some embodiments, genetic variations and alleles can be used to associate an inherited phenotype, for example, a developmental disorder, with a responsible genotype. In some embodiments, a developmental disorder risk allele can be a variant allele that is statistically associated with a screening of one or more developmental disorders. In some embodiments, genetic variations can be of any measurable frequency in the population, for example, a frequency higher than 10%, a frequency between 5-10%, a frequency between 1-5%, or frequency below 1%. As used herein, variant alleles can be alleles that differ from a reference allele. As used herein, a variant can be a segment of DNA that differs from the reference DNA, such as a genetic variation. In some embodiments, genetic variations can be used to track the inheritance of a gene that has not yet been identified, but whose approximate location is known.

As used herein, a haplotype can be information regarding the presence or absence of one or more genetic markers in a given chromosomal region in a subject. In some embodiments, a haplotype can be a segment of DNA characterized by one or more alleles arranged along the segment, for example, a haplotype can comprise one member of the pair of alleles for each genetic variation or locus. In some embodiments, the haplotype can comprise two or more alleles, three or more alleles, four or more alleles, five or more alleles, or any combination thereof, wherein, each allele can comprise one or more genetic variations along the segment.

In some embodiments, a genetic variation can be a functional aberration that can alter gene function, gene expression, protein expression, protein function, or any combination thereof. In some embodiments, a genetic variation can be a loss-of-function mutation, gain-of-function mutation, dominant negative mutation, or reversion. In some embodiments, a genetic variation can be part of a gene's coding region or regulatory region. Regulatory regions can control gene expression and thus protein expression. In some embodiments, a regulatory region can be a segment of DNA wherein regulatory proteins, for example, transcription factors, can bind. In some embodiments a regulatory region can be positioned near the gene being regulated, for example, positions upstream of the gene being regulated.

In some embodiments, variants can include changes that affect a polypeptide, such as a change in expression level, sequence, function, localization, binding partners, or any combination thereof. In some embodiments, a genetic variation can be a frameshift mutation, nonsense mutation, missense mutation, neutral mutation, or silent mutation. For example, sequence differences, when compared to a reference nucleotide sequence, can include the insertion or deletion of a single nucleotide, or of more than one nucleotide, resulting in a frame shift; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of a reading frame; duplication of all or a part of a sequence; transposition; or a rearrangement of a nucleotide sequence. Such sequence changes can alter the polypeptide encoded by the nucleic acid, for example, if the change in the nucleic acid sequence causes a frame shift, the frame shift can result in a change in the encoded amino acids, and/or can result in the generation of a premature stop codon, causing generation of a truncated polypeptide. In some embodiments, a genetic variation associated with a developmental disorder can be a synonymous change in one or more nucleotides, for example, a change that does not result in a change in the amino acid sequence. Such a polymorphism can, for example, alter splice sites, affect the stability or transport of mRNA, or otherwise affect the transcription or translation of an encoded polypeptide. In some embodiments, a synonymous mutation can result in the protein product having an altered structure due to rare codon usage that impacts protein folding during translation, which in some cases may alter its function and/or drug binding properties if it is a drug target. In some embodiments, the changes that can alter DNA to increase the possibility that structural changes, such as amplifications or deletions, occur at the somatic level. A polypeptide encoded by the reference nucleotide sequence can be a reference polypeptide with a particular reference amino acid sequence, and polypeptides encoded by variant nucleotide sequences can be variant polypeptides with variant amino acid sequences.

In some embodiments, one or more variant polypeptides or proteins can be associated with one or more diseases or disorders, such as ASD. In some embodiments, variant polypeptides and changes in expression, localization, and interaction partners thereof, can be used to associate an inherited phenotype, for example, a developmental disorder, with a responsible genotype. In some embodiments, a developmental disorder associated variant polypeptide can be statistically associated with a diagnosis, prognosis, or theranosis of one or more developmental disorders.

The most common sequence variants comprise base variations at a single base position in the genome, and such sequence variants, or polymorphisms, are commonly called single nucleotide polymorphisms (SNPs) or single nucleotide variants (SNVs). In some embodiments, a SNP represents a genetic variant present at greater than or equal to 1% occurrence in a population and in some embodiments a SNP can represent a genetic variant present at any frequency level in a population. A SNP can be a nucleotide sequence variation occurring when a single nucleotide at a location in the genome differs between members of a species or between paired chromosomes in a subject. SNPs can include variants of a single nucleotide, for example, at a given nucleotide position, some subjects can have a 'G', while others can have a 'C'. SNPs can occur in a single mutational event, and therefore there can be two possible alleles possible at each SNP site; the original allele and the mutated allele. SNPs that are found to have two different bases in a single nucleotide position are referred to as biallelic SNPs, those with three are referred to as triallelic, and those with all four bases represented in the population are quadallelic. In some embodiments, SNPs can be considered neutral. In some embodiments SNPs can affect susceptibility to developmental disorders. SNP polymorphisms can have two alleles, for example, a subject can be homozygous for one allele of the polymorphism wherein both chromosomal copies of the individual have the same nucleotide at the SNP location, or a subject can be heterozygous wherein the two sister chromosomes of the subject contain different nucleotides. The SNP nomenclature as reported herein is the official Reference SNP (rs) ID identification tag as assigned to each unique SNP by the National Center for Biotechnological Information (NCBI).

Another genetic variation of the disclosure can be copy number variations (CNVs). CNVs can be alterations of the DNA of a genome that results an abnormal number of copies of one or more sections of DNA. CNVs can be inherited or caused by de novo mutation and can be responsible for a substantial amount of human phenotypic variability, behavioral traits, and disease susceptibility. In a preferred embodiment, CNVs of the current disclosure can be associated with susceptibility to one or more developmental disorders, for example, ASD. In some embodiments, CNVs can be a single gene or include a contiguous set of genes. In some embodiments, CNVs can be caused by structural rearrangements of the genome, for example, unbalanced translocations, insertions, deletions, amplifications, inversions and interstitial deletions. In some embodiments, these structural rearrangements occur on one or more chromosomes. Low copy repeats (LCRs), which are region-specific repeat sequences, can be susceptible to these structural rearrangements, resulting in CNVs. Factors such as size, orientation, percentage similarity and the distance between the copies can influence the susceptibility of LCRs to genomic rearrangement. In some embodiments, CNVs are referred to as structural variants. In some embodiments, structural variants can be a broader class of variant that can also includes copy number neutral alterations such as inversions and balanced translocations.

CNVs can account for genetic variation affecting a substantial proportion of the human genome, for example, known CNVs can cover over 15% of the human genome sequence (Estivill, X Armengol; L., PLoS Genetics 3: 1787-99 (2007)). CNVs can affect gene expression, phenotypic variation and adaptation by disrupting gene dosage, and can cause disease, for example, microdeletion and microduplication disorders, and can confer susceptibility to diseases and disorders. Updated information about the location, type, and size of known CNVs can be found in one or more databases, for example, the Database of Genomic Variants (http://projects.tcag.ca/variation/), which currently contains data for over 66,000 CNVs (as of Nov. 2, 2010).

Other types of sequence variants can be found in the human genome and can be associated with a disease or disorder, including but not limited to, microsatellites. Microsatellite markers are stable, polymorphic, easily analyzed, and can occur regularly throughout the genome, making them especially suitable for genetic analysis. A polymorphic microsatellite can comprise multiple small repeats of bases, for example, CA repeats, at a particular site wherein the number of repeat lengths varies in a population. In some embodiments, microsatellites, for example, variable number of tandem repeats (VNTRs), can be short segments of DNA that have one or more repeated sequences, for example, about 2 to 5 nucleotides long, that can occur in non-coding DNA. In some embodiments, changes in microsatellites can occur during genetic recombination of sexual reproduction, increasing or decreasing the number of repeats found at an allele, or changing allele length.

Developmental Disorders

Developmental disorders are disorders that occur at some stage in a child's development, often retarding the development, including psychological or physical disorders. In some embodiments, they can be distinguished into specific developmental disorders including Pervasive Developmental Disorders (PDDs) and Pervasive Developmental Disorder-Not Otherwise Specified (PDD-NOS). A PDD can comprise ASD. Generally, symptoms that may be present to some degree in a subject of the present disclosure with a PDD can include difficulty with verbal communication, including problems using and understanding language, difficulty with non-verbal communication, such as gestures and facial expressions such as smiling, difficulty with social interaction, including relating to people and to his or her surroundings, unusual ways of playing with toys and other objects, difficulty adjusting to changes in routine or familiar surroundings, repetitive body movements or patterns of behavior, such as hand flapping, spinning, and head banging, changing response to sound, temper tantrums, difficulty sleeping, aggressive behavior, and/or fearfulness or anxiety. ASD can be defined by a certain set of behaviors that can range from the very mild to the severe. Possible indicators of ASDs include a subject whom does not babble, point, or make meaningful gestures by 1 year of age; does not speak one word by 16 months, does not combine two words by 2 years, does not respond to their name, and/or loses language or social skills. Other symptoms include qualitative impairment in social interaction, as manifested by marked impairments in the use of multiple nonverbal behaviors such as eye-to-eye gaze, facial expression, body posture, and gestures to regulate social interaction, failure to develop peer relationships appropriate to developmental level, a lack of spontaneous seeking to share enjoyment, interests, or achievements with other people, (e.g., by a lack of showing, bringing, or pointing out objects of interest to other people), or lack of social or emotional reciprocity (note: in the description, it gives the following as examples: not actively participating in simple social play or games, preferring solitary activities, or involving others in activities only as tools or "mechanical" aids). Symptoms of Autism can also include qualitative impairments in communication as manifested by delay in, or total lack of, the development of spoken language (not accompanied by an attempt to compensate through alternative modes of communication such as gesture or mime), in individuals with adequate speech, marked impairment in the ability to initiate or sustain a conversation with others, stereotyped and repetitive use of language or idiosyncratic language, or lack of varied, spontaneous make-believe play or social imitative play appropriate to developmental level. Other symptoms of Autism include restricted repetitive and stereotyped patterns of behavior, interests and activities, as manifested by encompassing preoccupation with one or more stereotyped and restricted patterns of interest that is abnormal either in intensity or focus, apparently inflexible adherence to specific, nonfunctional routines or rituals, stereotyped and repetitive motor mannerisms (e.g hand or finger flapping or twisting, or complex whole-body movements), or persistent preoccupation with parts of objects. Other symptoms of Autism include delays or abnormal functioning in at areas, with onset prior to age 3 years including social interaction, language as used in social communication and symbolic or imaginative play As described herein, Pervasive Developmental Disorders-Not Otherwise Specified (PDD-NOS) can comprise Asperger Syndrome, Rett Syndrome, fragile X syndrome, and/or Childhood Disintegrative Disorder. In some embodiments a screening of PDD-NOS can be a screening of being on the autism spectrum, but not falling within any of the existing specific categories of autism. PDD-NOS is a pervasive developmental disorder (PDD)/autism spectrum disorder (ASD) and is often referred to as atypical autism.

Symptoms of Asperger Syndrome can include qualitative impairment in social interaction, marked impairments in the use of multiple nonverbal behaviors such as eye-to-eye gaze, facial expression, body posture, and gestures to regulate social interaction, failure to develop peer relationships appropriate to developmental level a lack of spontaneous seeking to share enjoyment, interest or achievements with other people, (e.g. by a lack of showing, bringing, or pointing out objects of interest to other people) and lack of social or emotional reciprocity. Other symptoms can include restricted repetitive & stereotyped patterns of behavior, interests and activities, encompassing preoccupation with one or more stereotyped and restricted patterns of interest that is abnormal either in intensity or focus apparently inflexible adherence to specific, nonfunctional routines or rituals stereotyped and repetitive motor mannerisms (e.g. hand or finger flapping or twisting, or complex whole-body movements) and persistent preoccupation with parts of objects and clinically significant impairments in social, occupational, or other important areas of functioning. There may be no clinically significant general delay in language (for example, single words used by age 2 years, communicative phrases used by age 3 years). There may be no clinically significant delay in cognitive development or in the development of age-appropriate self help skills, adaptive behavior (other than in social interaction) and curiosity about the environment in childhood.

Although apparently normal prenatal and perinatal development, apparently normal psychomotor development through the first 5 months after birth, normal head circumference at birth are observed, symptoms of Rett Syndrome begin after the period of normal development and include deceleration of head growth between ages 5 and 48 months, loss of previously acquired purposeful hand skills between ages 5 and 30 months with the subsequent development of stereotyped hand movements (i.e., hand-wringing or hand washing), loss of social engagement early in the course (although often social interaction develops later), appearance of poorly coordinated gait or trunk movements, and severely impaired expressive and receptive language development with severe psychomotor retardation.

Although apparently normal development occurs for at least the first 2 years after birth, Childhood Disintegrative Disorder symptoms manifest by the presence of age-appropriate verbal and nonverbal communication, social relationships, play, and adaptive behavior. Symptoms include clinically significant loss of previously acquired skills (before age 10 years) including expressive or receptive language, social skills or adaptive behavior, bowel or bladder control, play, and motor skills. Other symptoms include abnormalities of functioning in areas including qualitative impairment in social interaction (e.g., impairment in nonverbal behaviors, failure to develop peer relationships, lack of social or emotional reciprocity), qualitative impairments in communication (e.g., delay or lack of spoken language, inability to initiate or sustain a conversation, stereotyped and repetitive use of language, lack of varied make-believe play), and restricted, repetitive, and stereotyped patterns of behavior, interests, and activities, including motor stereotypes and mannerisms.

Subjects

A subject, as used herein, can be an individual of any age or sex from whom a sample containing nucleotides is obtained for analysis by one or more methods described herein so as to obtain genetic data, for example, a male or female adult, child, newborn, or fetus. In some embodiments, a subject can be any target of therapeutic administration. In some embodiments, a subject can be a test subject or a reference subject. In some embodiments, a subject can be associated with a condition or disease or disorder, asymptomatic or symptomatic, have increased or decreased susceptibility to a disease or disorder, be associated or unassociated with a treatment or treatment regimen, or any combination thereof. As used in the present disclosure a cohort can represent an ethnic group, a patient group, a particular age group, a group not associated with a particular disease or disorder, a group associated with a particular disease or disorder, a group of asymptomatic subjects, a group of symptomatic subjects, or a group or subgroup of subjects associated with a particular response to a treatment regimen or clinical trial. In some embodiments, a patient can be a subject afflicted with a disease or disorder. In some embodiments, a patient can be a subject not afflicted with a disease or disorder. In some embodiments, a subject can be a test subject, a patient or a candidate for a therapeutic, wherein genomic DNA from said subject, patient, or candidate is obtained for analysis by one or more methods of the present disclosure herein, so as to obtain genetic variation information of said subject, patient or candidate.

In some embodiments, the sample can be obtained prenatally from a fetus or embryo or from the mother, for example, from fetal or embryonic cells in the maternal circulation. In some embodiments, the sample can be obtained with the assistance of a health care provider, for example, to draw blood. In some embodiments, the sample can be obtained without the assistance of a health care provider, for example, where the sample is obtained noninvasively, such as a sample comprising buccal cells that is obtained using a buccal swab or brush, or a mouthwash sample.

The present disclosure also provides methods for assessing genetic variations in subjects who are members of a target population. Such a target population is in some embodiments a population or group of subjects at risk of developing the disease, based on, for example, other genetic factors, biomarkers, biophysical parameters, family history of a developmental disorder, previous screening or medical history, or any combination thereof.

Although ASD is known to affect children to a higher extent than adults, subjects of all ages are contemplated in the present disclosure. In some embodiments subjects can be from specific age subgroups, such as those over the age of 1, over the age of 2, over the age of 3, over the age of 4, over the age of 5, over the age of 6, over the age of 7, over the age of 8, over the age of 9, over the age of 10, over the age of 15, over the age of 20, over the age of 25, over the age of 30, over the age of 35, over the age of 40, over the age of 45, over the age of 50, over the age of 55, over the age of 60, over the age of 65, over the age of 70, over the age of 75, over the age of 80, or over the age of 85. Other embodiments of the disclosure pertain to other age groups, such as subjects aged less than 85, such as less than age 80, less than age 75, less than age 70, less than age 65, less than age 60, less than age 55, less than age 50, less than age 45, less than age 40, less than age 35, less than age 30, less than age 25, less than age 20, less than age 15, less than age 10, less than age 9, less than age 8, less than age 6, less than age 5, less than age 4, less than age 3, less than age 2, or less than age 1. Other embodiments relate to subjects with age at onset of the disease in any of particular age or age ranges defined by the numerical values described in the above or other numerical values bridging these numbers. It is also contemplated that a range of ages can be relevant in certain embodiments, such as age at onset at more than age 15 but less than age 20. Other age ranges are however also contemplated, including all age ranges bracketed by the age values listed in the above.

The genetic variations of the present disclosure found to be associated with a developmental disorder can show similar association in other human populations. Particular embodiments comprising subject human populations are thus also contemplated and within the scope of the disclosure. Such embodiments relate to human subjects that are from one or more human populations including, but not limited to, Caucasian, European, American, Eurasian, Asian, Central/South Asian, East Asian, Middle Eastern, African, Hispanic, and Oceanic populations. European populations include, but are not limited to, Swedish, Norwegian, Finnish, Russian, Danish, Icelandic, Irish, Kelt, English, Scottish, Dutch, Belgian, French, German, Spanish, Portuguese, Italian, Polish, Bulgarian, Slavic, Serbian, Bosnian, Czech, Greek and Turkish populations. The racial contribution in subject subjects can also be determined by genetic analysis, for example, genetic analysis of ancestry can be carried out using unlinked microsatellite markers such as those set out in Smith et al. (Am J Hum Genet 74, 1001-13 (2004))

It is also well known to the person skilled in the art that certain genetic variations have different population frequencies in different populations, or are polymorphic in one population but not in another. A person skilled in the art can however apply the methods available and as thought herein to practice the present disclosure in any given human population. This can include assessment of genetic variations of the present disclosure, so as to identify those markers that give strongest association within the specific population. Thus, the at-risk variants of the present disclosure can reside on different haplotype background and in different frequencies in various human populations.

Samples

Samples that are suitable for use in the methods described herein can be from a subject and can contain genetic or proteinaceous material, for example, genomic DNA (gDNA). Genetic material can be extracted from one or more biological samples including but not limited to, blood, saliva, urine, mucosal scrapings of the lining of the mouth, expectorant, serum, tears, skin, tissue, or hair.

In some embodiments, the sample can comprise cells or tissue, for example, cell lines. Exemplary cell types from which genetic material can be obtained using the methods described herein and include but are not limited to, a blood cell; such as a B lymphocyte, T lymphocyte, leukocyte, erythrocyte, macrophage, or neutrophil; a muscle cell such as a skeletal cell, smooth muscle cell or cardiac muscle cell; a germ cell, such as a sperm or egg; an epithelial cell; a connective tissue cell, such as an adipocyte, chondrocyte; fibroblast or osteoblast; a neuron; an astrocyte; a stromal cell; an organ specific cell, such as a kidney cell, pancreatic cell, liver cell, or a keratinocyte; a stem cell; or any cell that develops there from. A cell from which gDNA is obtained can be at a particular developmental level including, for example, a hematopoietic stem cell or a cell that arises from a hematopoietic stem cell such as a red blood cell, B lymphocyte, T lymphocyte, natural killer cell, neutrophil, basophil, eosinophil, monocyte, macrophage, or platelet. Generally any type of stem cell can be used including, without limitation, an embryonic stem cell, adult stem cell, or pluripotent stem cell.

In some embodiments, a sample can be processed for DNA isolation, for example, DNA in a cell or tissue sample can be separated from other components of the sample. Cells can be harvested from a biological sample using standard techniques known in the art, for example, by centrifuging a cell sample and resuspending the pelleted cells, for example, in a buffered solution, for example, phosphate-buffered saline (PBS). In some embodiments, after centrifuging the cell suspension to obtain a cell pellet, the cells can be lysed to extract DNA. In some embodiments, the sample can be concentrated and/or purified to isolate DNA. All samples obtained from a subject, including those subjected to any sort of further processing, are considered to be obtained from the subject. In some embodiments, standard techniques and kits known in the art can be used to extract genomic DNA from a biological sample, including, for example, phenol extraction, a QIAamp® Tissue Kit (Qiagen, Chatsworth, Calif.), a Wizard® Genomic DNA purification kit (Promega), or a Qiagen Autopure method using Puregene chemistry, which can enable purification of highly stable DNA well-suited for archiving.

In some embodiments, determining the identity of an allele or determining copy number can, but need not, include obtaining a sample comprising DNA from a subject, and/or assessing the identity, copy number, presence or absence of one or more genetic variations and their chromosomal locations in the sample. The individual or organization that performs the determination need not actually carry out the physical analysis of a sample from a subject. In some embodiments, the methods can include using information obtained by analysis of the sample by a third party. In some embodiments, the methods can include steps that occur at more than one site. For example, a sample can be obtained from a subject at a first site, such as at a health care provider or at the subject's home in the case of a self-testing kit. The sample can be analyzed at the same or a second site, for example, at a laboratory or other testing facility.

Methods of Screening

As used herein, screening a subject comprises diagnosing or determining, theranosing, or determining the susceptibility to developing (prognosing) a developmental disorder, for example, ASD. In particular embodiments, the disclosure is a method of determining a presence of, or a susceptibility to, a developmental disorder, by detecting at least one genetic variation in a sample from a subject as described herein. In some embodiments, detection of particular alleles, markers, variations, or haplotypes is indicative of a presence or susceptibility to a developmental disorder. Although there can be many concerns about screening a subject with an ASD, the earlier the screening of ASD is made, the earlier needed interventions can begin. Evidence over the last 15 years indicates that intensive early intervention in optimal educational settings for at least 2 years during the preschool years results in improved outcomes in most young children with ASD. In evaluating a child, clinicians rely on behavioral characteristics to make a diagnosis, prognosis, or theranosis. Some of the characteristic behaviors of ASD may be apparent in the first few months of a child's life, or they may appear at any time during the early years. For the screening problems in at least one of the areas of communication, socialization, or restricted behavior must be present before the age of 3. The screening requires a two-stage process. The first stage involves developmental screening during "well-child" check-ups; the second stage entails a comprehensive evaluation by a multidisciplinary team. A "well child" check-up should include a developmental screening test. Several screening instruments have been developed to quickly gather information about a child's social and communicative development within medical settings. Among them are the Checklist of Autism in Toddlers (CHAT), the modified Checklist for Autism in Toddlers (M-CHAT), the Screening Tool for Autism in Two-Year-Olds (STAT), and the Social Communication Questionnaire (SCQ) for children 4 years of age and older. Some screening instruments rely solely on parent responses to a questionnaire, and some rely on a combination of parent report and observation. Key items on these instruments that appear to differentiate children with autism from other groups before the age of 2 include pointing and pretend play. Screening instruments do not provide individual diagnosis, prognosis, or theranosis, but serve to assess the need for referral for possible screening of ASD. These screening methods may not identify children with mild ASD, such as those with high-functioning autism or Asperger syndrome. The second stage of screening must be comprehensive in order to accurately rule in or rule out an ASD or other developmental problem. This evaluation may be done by a multidisciplinary team that includes a psychologist, a neurologist, a psychiatrist, a speech therapist, or other professionals who screen children with ASD. Because ASDs are complex disorders and may involve other developmental or genetic problems, a comprehensive evaluation should entail developmental and genetic assessment, along with in-depth cognitive and language testing. In addition, measures developed specifically for screening autism are often used. These include the Autism Diagnosis Interview-Revised (ADI-R) and the Autism Diagnostic Observation Schedule (ADOS-G). The ADI-R is a structured interview that contains over 100 items and is conducted with a caregiver. It consists of four main factors including the child's communication, social interaction, repetitive behaviors, and age-of-onset symptoms. The ADOS-G is an observational measure used to "press" for socio-communicative behaviors that are often delayed, abnormal, or absent in children with ASD. Still another instrument often used by professionals is the Childhood Autism Rating Scale (CARS). It can aid in evaluating the child's body movements, adaptation to change, listening response, verbal communication, and relationship to people. It is suitable for use with children over 2 years of age. The examiner observes the child and also obtains relevant information from the parents. The child's behavior is rated on a scale based on deviation from the typical behavior of children of the same age. Two other tests that can be used to assess any child with a developmental delay are a formal audiologic hearing evaluation and a lead screening.

Although some hearing loss can co-occur with ASD, some children with ASD may be incorrectly thought to have such a loss. In addition, if the child has suffered from an ear infection, transient hearing loss can occur. Lead screening is essential for children who remain for a long period of time in the oral-motor stage in which they put any and everything into their mouths. Children with an autistic disorder usually have elevated blood lead levels. Customarily, an expert screening team has the responsibility of thoroughly evaluating the child, assessing the child's unique strengths and weaknesses, and determining a formal screen. The team will then meet with the parents to explain the results of the evaluation.

PDD-NOS is typically screened by psychologists and Pediatric Neurologists. No singular specific test can be administered to determine whether or not a child is on the spectrum. Screening can be made through observations, questionnaires, and tests. A parent will usually initiate the quest into the screening with questions for their child's pediatrician about their child's development after noticing abnormalities. From there, doctors will ask questions to gauge the child's development in comparison to age-appropriate milestones. One test that measures this is the Modified Checklist of Autism in Toddlers (MCHAT). This is a list of questions whose answers will determine whether or not the child should be referred to a specialist such as a developmental pediatrician, a neurologist, a psychiatrist, or a psychologist. Another checklist, the DSM-IV is a series of characteristics and criteria to qualify for an autism diagnosis. Because PDD-NOS is a spectrum disorder, not every child shows the same signs. The two main characteristics of the disorder are difficulties with social interaction skills and communication. Signs are often visible in babies but a diagnosis is usually not made until around age 4. Even though PDD-NOS is considered milder than typical autism, this is not always true. While some characteristics may be milder, others may be more severe. Once a child with PDD-NOS enters school, he or she will often be very eager to interact with classmates, but may act socially different to peers and be unable to make genuine connections. As they age, the closest connections they make are typically with their parents. Children with PDD-NOS have difficulty reading facial expressions and relating to feelings of others. They may not know how to respond when someone is laughing or crying. Literal thinking is also characteristic of PDD-NOS. They will most likely have difficulty understanding figurative speech and sarcasm. Inhibited communication skills are a sign of PDD-NOS that begins immediately after birth. As an infant, they will not babble, and as they age, they do not speak when age appropriate. Once verbal communication begins, their vocabulary is often limited. Some characteristics of language-based patterns are: repetitive or rigid language, narrow interests, uneven language development, and poor nonverbal communication. A very common characteristic of PDD-NOS is severe difficulty grasping the difference between pronouns, particularly between "you" and "me" when conversing. During the last few years, screening instruments have been devised to screen for Asperger syndrome and higher functioning autism. The Autism Spectrum Screening Questionnaire (ASSQ), the Australian Scale for Asperger's Syndrome, and the most recent, the Childhood Asperger Syndrome Test (CAST), are some of the instruments that are reliable for identification of school-age children with Asperger syndrome or higher functioning autism. These tools concentrate on social and behavioral impairments in children without significant language delay. If, following the screening process or during a routine "well child" check-up, a subject's doctor sees any of the possible indicators of ASD, further evaluation is indicated.

While means for screening ASDs exist, many times symptoms go unnoticed until late in childhood or symptoms are so minor they are left unnoticed. Thus there exists a need for an improved ASD screening test. Described herein are methods of screening an individual for one or more developmental disorders, including but not limited to, determining the identity and location of genetic variations, such as variations in nucleotide sequence and copy number, and the presence or absence of alleles or genotypes in one or more samples from one or more subjects using any of the methods described herein. In some embodiments, determining an association to having or developing a developmental disorder can be performed by detecting particular variations that appear more frequently in test subjects compared to reference subjects and analyzing the molecular and physiological pathways these variations can affect.

Within any given population, there can be an absolute susceptibility of developing a disease or trait, defined as the chance of a person developing the specific disease or trait over a specified time-period. Susceptibility (e.g. being at-risk) is typically measured by looking at very large numbers of people, rather than at a particular individual. As described herein, certain copy number variations (genetic variations) are found to be useful for susceptibility assessment of a developmental disorder. Susceptibility assessment can involve detecting particular genetic variations in the genome of individuals undergoing assessment. Particular genetic variations are found more frequently in individuals with a developmental disorder, than in individuals without screening of a developmental disorder. Therefore, these genetic variations have predictive value for detecting a developmental disorder, or a susceptibility to a developmental disorder, in an individual. Without intending to be limited by theory, it is believed that the genetic variations described herein to be associated with susceptibility of a developmental disorder represent functional variants predisposing to the disease. In some embodiments, a genetic variation can confer a susceptibility of the condition, for example, carriers of the genetic variation are at a different risk of the condition than non-carriers. In a preferred embodiment, the presence of a genetic variation is indicative of increased susceptibility to a developmental disorder, such as ASD.

In some embodiments, screening can be performed using any of the methods disclosed, alone or in combination. In some embodiments, screening can be performed using Polymerase Chain Reaction (PCR). In a preferred embodiment screening can be performed using Array Comparative Genomic Hybridization (aCGH). In some embodiments, the genetic variation information as it relates to the current disclosure can be used in conjunction with any of the above mentioned symptomatic screening tests to screen a subject for ASD, for example, using a combination of aCGH and a childhood screening test, such as the Checklist of Autism in Toddlers (CHAT).

In some embodiments, information from any of the above screening methods (e.g. specific symptoms, scoring matrix, or genetic variation data) can be used to define a subject as a test subject or reference subject. In some embodiments, information from any of the above screening methods can be used to associate a subject with a test or reference population, for example, a subject in a population. In the present study, for example, all the probands in Tables 1 and 5 met the criteria for autism on one or both of the screening measures including the Autism Diagnostic Interview-Revised (ADI-R) training and the Autism Diagnostic Observation Schedule (ADOS) training.

In one embodiment, an association with a developmental disorder can determined by the statistical likelihood of the presence of a genetic variation in a subject with a developmental disorder, for example, an unrelated individual or a first or second-degree relation of the subject. In some embodiments, an association with a developmental disorder can be determined by determining the statistical likelihood of the absence of a genetic variation in an unaffected reference subject, for example, an unrelated individual or a first or second-degree relation of the subject. The methods described herein can include obtaining and analyzing a sample from one or more suitable reference subjects.

In the present context, the term screening comprises diagnosis, prognosis, and theranosis. Screening can refer to any available screening method, including those mentioned herein. As used herein, susceptibility can be proneness of a subject towards the development of a developmental condition, or towards being less able to resist a particular developmental condition than one or more control subjects. In some embodiments, susceptibility can encompass increased susceptibility. For example, particular nucleic acid variations of the disclosure as described herein can be characteristic of increased susceptibility to development of a developmental disorder. In some embodiments, susceptibility can encompass decreased susceptibility, for example, particular nucleic variations of the disclosure as described herein can be characteristic of decreased susceptibility to development of a developmental disorder.

As described herein, a genetic variation predictive of susceptibility to or presence of a developmental disorder can be one where the particular genetic variation is more frequently present in a subject with the condition (affected), compared to the frequency of its presence in a reference group (control), such that the presence of the genetic variation is indicative of susceptibility to or presence of the developmental disorder. In some embodiments, the reference group can be a population sample, for example, a random sample from the general population or a mixture of two or more samples from a population. In some embodiments, disease-free controls can be characterized by the absence of one or more specific disease-associated symptoms, for example, individuals who have not experienced symptoms associated with a developmental disorder. In another embodiment, the disease-free control group is characterized by the absence of one or more disease-specific risk factors, for example, at least one genetic and/or environmental risk factor. In some embodiments, a reference sequence can be referred to for a particular site of genetic variation. In some embodiments, a reference allele can be a wild-type allele and can be chosen as either the first sequenced allele or as the allele from a control individual. In some embodiments, one or more reference subjects can be characteristically matched with one or more affected subjects, for example, with matched aged, gender or ethnicity.

A person skilled in the art will appreciate that for genetic variations with two alleles present in the population being studied, and wherein one allele can found in increased frequency in a group of individuals with a developmental disorder in the population, compared with controls, the other allele of the marker can be found in decreased frequency in the group of individuals with the trait or disease, compared with controls. In such a case, one allele of the marker, for example, the allele found in increased frequency in individuals with a developmental disorder, can be the at-risk allele, while the other allele can be a neutral or protective allele.

A genetic variant associated with a developmental disorder can be used to predict the susceptibility of the disease for a given genotype. For any genetic variation, there can be one or more possible genotypes, for example, homozygote for the at-risk variant (e.g., in autosomal recessive disorders), heterozygote, and non-carrier of the at-risk variant. In some embodiments, susceptibility associated with variants at multiple loci can be used to estimate overall susceptibility. For multiple genetic variants, there can be k ($k=3^n*2^P$) possible genotypes; wherein n can be the number of autosomal loci and p can be the number of gonosomal (sex chromosomal) loci. Overall susceptibility assessment calculations can assume that the relative susceptibilities of different genetic variants multiply, for example, the overall susceptibility associated with a particular genotype combination can be the product of the susceptibility values for the genotype at each locus. If the susceptibility presented is the relative susceptibility for a person, or a specific genotype for a person, compared to a reference population, then the combined susceptibility can be the product of the locus specific susceptibility values and can correspond to an overall susceptibility estimate compared with a population. If the susceptibility for a person is based on a comparison to non-carriers of the at-risk allele, then the combined susceptibility can correspond to an estimate that compares the person with a given combination of genotypes at all loci to a group of individuals who do not carry at-risk variants at any of those loci. The group of non-carriers of any at-risk variant can have the lowest estimated susceptibility and can have a combined susceptibility, compared with itself, for example, non-carriers, of 1.0, but can have an overall susceptibility, compared with the population, of less than 1.0.

Overall risk for multiple risk variants can be performed using standard methodology. Genetic variations described herein can form the basis of risk analysis that combines other genetic variations known to increase risk of a developmental disorder, or other genetic risk variants for a developmental disorder. In certain embodiments of the disclosure, a plurality of variants (genetic variations, variant alleles, and/or haplotypes) can be used for overall risk assessment. These variants are in some embodiments selected from the genetic variations as disclosed herein. Other embodiments include the use of the variants of the present disclosure in combination with other variants known to be useful for screening a susceptibility to a developmental disorder. In such embodiments, the genotype status of a plurality of genetic variations, markers and/or haplotypes is determined in an individual, and the status of the individual compared with the population frequency of the associated variants, or the frequency of the variants in clinically healthy subjects, such as age-matched and sex-matched subjects.

Methods known in the art, such as the use of available algorithms and software can be used to identify, or call, significant genetic variations, including but not limited to, algorithms of DNA Analytics or DNAcopy, iPattern and/or QuantiSNP. For example, an Aberration Detection Module 2 (ADM2) algorithm, such as that of DNA Analytics 4.0.85 can be used to identify, or call, significant genetic variations. In some embodiments, two or more algorithms can be used to identify, or call, significant genetic variations. For example, 2, 3, 4, 5, 6, 7, 8, 9, or 10 or more algorithms can be used to identify, or call, significant genetic variations. In some embodiments, significant genetic variations can be CNVs.

CNVs detected by 2 or more algorithms can be defined as stringent and can be utilized for further analyses. In some embodiments, the information and calls from two or more of the methods described herein can be compared to each other to identify significant genetic variations more or less stringently. For example, CNV calls generated by both Aberration Detection Module 2 (ADM2) algorithms and DNAcopy algorithms can be defined as stringent CNVs. In some embodiments, significant or stringent genetic variations can be tagged as identified or called if it can be found to have a minimal reciprocal overlap to a genetic variation detected by one or more platforms and/or methods described herein. For example, significant or stringent genetic variations can be tagged as identified or called if it can be found to have a reciprocal overlap of more than about 50%, 55% 60%, 65%, 70%, 75%, 80%, 85%, 90%, or 95%, 99%, or equal to 100%, to a genetic variation detected by one or more platforms and/or methods described herein. For example, significant or stringent genetic variations can be tagged as identified or called if it can be found to have a reciprocal overlap of more than about 50% reciprocal overlap to a genetic variation detected by one or more platforms and/or methods described herein.

In some embodiments, a threshold log ratio value can be used to determine losses and gains. A log ratio value can be any log ratio value; for example, a log ratio value can be a log 2 ratio or a log 10 ratio. In some embodiments, a CNV segment whose median log 2 ratio is less than or equal to a log 2 ratio threshold value can be classified as a loss. For example, any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss.

In some embodiments, one algorithm can be used to call or identify significant genetic variations, wherein any segment whose median log 2 ratio was less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss. For example, any CNV segment whose median log 2 ratio is less than −0.35 as determined by DNAcopy can be classified as a loss. For example, losses can be determined according to a threshold log 2 ratio, which can be set at −0.35.

In some embodiments, two algorithms can be used to call or identify significant genetic variations, wherein any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, as determined by one algorithm, and wherein any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20, or less, as determined by the other algorithm can be classified as a loss. For example, CNV calling can comprise using the Aberration Detection Module 2 (ADM2) algorithm and the DNAcopy algorithm, wherein losses can be determined according to a two threshold log 2 ratios, wherein the Aberration Detection Module 2 (ADM2) algorithm log 2 ratio can be −0.25 and the DNAcopy algorithm log 2 ratio can be −0.41.

In some embodiments, the use of two algorithms to call or identify significant genetic variations can be a stringent method. In some embodiments, the use of two algorithms to call or identify significant genetic variations can be a more stringent method compared to the use of one algorithm to call or identify significant genetic variations.

In some embodiments, any CNV segment whose median log 2 ratio is greater than a log 2 ratio threshold value can be classified as a gain. For example, any segment whose median log 2 ratio is greater than 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain.

In some embodiments, one algorithm can be used to call or identify significant genetic variations, wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain. For example, any CNV segment whose median log 2 ratio is greater than 0.35 as determined by DNAcopy can be classified as a gain. For example, gains can be determined according to a threshold log 2 ratio, which can be set at 0.35.

In some embodiments, two algorithms can be used to call or identify significant genetic variations, wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3 or more, as determined by one algorithm, and wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more, as determined by the other algorithm the can be classified as a gain. For example, CNV calling can comprise using the Aberration Detection Module 2 (ADM2) algorithm and the DNAcopy algorithm, wherein gains can be determined according to a two threshold log 2 ratios, wherein the Aberration Detection Module 2 (ADM2) algorithm log 2 ratio can be 0.25 and the DNAcopy algorithm log 2 ratio can be 0.32.

Any CNV segment whose absolute (median log-ratio/mad) value is less than 2 can be excluded (not identified as a significant genetic variation). For example, any CNV segment whose absolute (median log-ratio/mad) value is less than 2, 1.9, 1.8, 1.7, 1.6, 1.5, 1.4, 1.3, 1.2, 1.1, 1, 0.9, 0.8, 0.7, 0.6, or 0.5 or less can be excluded.

In some embodiments, multivariate analyses or joint risk analyses, including the use of multiplicative model for overall risk assessment, and can subsequently be used to determine the overall risk conferred based on the genotype status at the multiple loci. Use of a multiplicative model, for example, assuming that the risk of individual risk variants multiply to establish the overall effect, allows for a straightforward calculation of the overall risk for multiple markers. The multiplicative model is a parsimonious model that usually fits the data of complex traits reasonably well. Deviations from multiplicity have been rarely described in the context of common variants for common diseases, and if reported are usually only suggestive since very large sample sizes are usually required to be able to demonstrate statistical interactions between loci. Assessment of risk based on such analysis can subsequently be used in the methods, uses and kits of the disclosure, as described herein.

In some embodiments, the significance of increased or decreased susceptibility can be measured by a percentage. In some embodiments, a significant increased susceptibility can be measured as a relative susceptibility of at least 1.2, including but not limited to: at least 1.5, at least 1.3, at least 1.4, at least 1.5, at least 1.6, at least 1.7, 1.8, at least 1.9, at least 2.0, at least 2.5, at least 3.0, at least 4.0, at least 5.0, at least 6.0, at least 7.0, at least 8.0, at least 9.0, at least 10.0, and at least 15.0. In some embodiments, a relative susceptibility of at least 2.0, at least 3.0, at least 4.0, at least, 5.0, at least 6.0, or at least 10.0 is significant. Other values for significant susceptibility are also contemplated, for example, at least 2.5, 3.5, 4.5, 5.5, or any suitable other numerical values, wherein said values are also within scope of the present disclosure. In some embodiments, a significant increase in susceptibility is at least about 20%, including but not limited to about 25%, 30%, 35%, 40%, 45%, 50%, 55%, 60%, 65%, 70%, 75%, 80%, 85%, 90%, 95%, 100%, 150%, 200%, 300%, 400%, 500%, 600%, 700%, 800%, 900%, 1000%, and 1500%. In one particular embodiment, a significant increase in susceptibility is at least 100%. In other embodiments, a significant increase in susceptibility is at least 200%, at least 300%, at least 400%, at least 500%, at least 700%, at least 800%, at least 900% and at least 1000%. Other cutoffs or ranges as deemed suitable by the person skilled in the art to characterize the disclosure are also contemplated, and those are also within scope of the present disclosure. In certain embodiments, a significant increase in susceptibility is characterized by a p-value, such as a p-value of less than 0.5, less than 0.4, less than 0.3, less than 0.2, less than 0.1, less than 0.05, less than 0.01, less than 0.001, less than 0.0001, less than 0.00001, less than 0.000001, less than 0.0000001, less than 0.00000001, or less than 0.000000001.

In some embodiments, an individual who is at a decreased susceptibility for or the lack of presence of a developmental condition can be an individual in whom at least one genetic variation, conferring decreased susceptibility for or the lack of presence of the developmental disorder is identified. In some embodiments, the genetic variations conferring decreased susceptibility are also said to be protective. In one aspect, the genetic variations can confer a significant decreased susceptibility of or lack of presence of the developmental disorder.

In some embodiments, significant decreased susceptibility can be measured as a relative susceptibility of less than 0.9, including but not limited to less than 0.9, less than 0.8, less than 0.7, less than 0.6, less than 0.5, less than 0.4, less than 0.3, less than 0.2 and less than 0.1. In another embodiment, the decrease in susceptibility is at least 20%, including but not limited to at least 25%, at least 30%, at least 35%, at least 40%, at least 45%, at least 50%, at least 55%, at least 60%, at least 65%, at least 70%, at least 75%, at least 80%, at least 85%, at least 90%, at least 95% and at least 98%. Other cutoffs or ranges as deemed suitable by the person, skilled in the art to characterize the disclosure are however also contemplated, and those are also within scope of the present disclosure. In certain embodiments, a significant decrease in susceptibility is characterized by a p-value, such as a p-value of less than 0.05, less than 0.01, less than 0.001, less than 0.0001, less than 0.00001, less than 0.000001, less than 0.0000001, less than 0.00000001, or less than 0.000000001. Other tests for significance can be used, for example, a Fisher-exact test. Other statistical tests of significance known to the skilled person are also contemplated and are also within scope of the disclosure.

In some preferred embodiments, the significance of increased or decreased susceptibility can be determined according to the ratio of measurements from a test subject to a reference subject. In a preferred embodiment, losses or gains of one or more CNVs can be determined according to a threshold $\log_2$ ratio determined by these measurements. In some embodiments, a $\log_2$ ratio value greater than 0.35 is indicative of a gain of one or more CNVs. In some embodiments, a $\log_2$ ratio value less than −0.35 is indicative of a loss of one or more CNVs. In some embodiments, the ratio of measurements from a test subject to a reference subject may be inverted such that the log 2 ratios of copy number gains are negative and the log 2 ratios of copy number losses are positive.

In some embodiments, the combined or overall susceptibility associated with a plurality of variants associated with a developmental disorder can also be assessed; for example, the genetic variations described herein to be associated with susceptibility to a developmental disorder can be combined with other common genetic risk factors. Combined risk for such genetic variants can be estimated in an analogous fashion to the methods described herein.

Calculating risk conferred by a particular genotype for the individual can be based on comparing the genotype of the individual to previously determined risk expressed, for example, as a relative risk (RR) or an odds ratio (OR), for the genotype, for example, for a heterozygous carrier of an at-risk variant for a developmental disorder. An odds ratio can be a statistical measure used as a metric of causality. For example, in genetic disease research it can be used to convey the significance of a variant in a disease cohort relative to an unaffected/normal cohort. The calculated risk for the individual can be the relative risk for a subject, or for a specific genotype of a subject, compared to the average population. The average population risk can be expressed as a weighted average of the risks of different genotypes, using results from a reference population, and the appropriate calculations to calculate the risk of a genotype group relative to the population can then be performed. Alternatively, the risk for an individual can be based on a comparison of particular genotypes, for example, heterozygous carriers of an at-risk allele of a marker compared with non-carriers of the at-risk allele. Using the population average can, in certain embodiments, be more convenient, since it provides a measure which can be easy to interpret for the user, such as a measure that gives the risk for the individual, based on his/her genotype, compared with the average in the population.

In certain embodiments of the disclosure, a genetic variation is correlated to a developmental disorder by referencing genetic variation data to a look-up table that comprises correlations between the genetic variation and a developmental disorder. The genetic variation in certain embodiments comprises at least one indication of the genetic variation. In some embodiments, the table comprises a correlation for one genetic variation. In other embodiments, the table comprises a correlation for a plurality of genetic variations In both scenarios, by referencing to a look-up table that gives an indication of a correlation between a genetic variation and a developmental disorder, a risk for a developmental disorder, or a susceptibility to a developmental disorder, can be identified in the individual from whom the sample is derived.

The present disclosure also pertains to methods of clinical screening, for example, diagnosis, prognosis, or theranosis of a subject performed by a medical professional using the methods disclosed herein. In other embodiments, the disclosure pertains to methods of screening performed by a layman. The layman can be a customer of a genotyping service. The layman can also be a genotype service provider, who performs genotype analysis on a DNA sample from an individual, in order to provide service related to genetic risk factors for particular traits or diseases, based on the genotype status of the subject obtained from use of the methods described herein. The resulting genotype information can be made available to the individual and can be compared to information about developmental disorder or risk of developing a developmental disorder associated with various genetic variations, including but not limited to, information from public literature and scientific publications. The screening applications of developmental disorder-associated genetic variations, as described herein, can, for example, be performed by an individual, a health professional, or a third party, for example, a service provider who interprets genotype information from the subject.

The information derived from analyzing sequence data can be communicated to any particular body, including the individual from which the sample or sequence data is derived, a guardian or representative of the individual, clinician, research professional, medical professional, service provider, and medical insurer or insurance company. Medical professionals can be, for example, doctors, nurses, medical laboratory technologists, and pharmacists. Research professionals can be, for example, principle investigators, research technicians, postdoctoral trainees, and graduate students.

In some embodiments, a professional can be assisted by determining whether specific genetic variants are present in a biological sample from a subject, and communicating information about genetic variants to a professional. After information about specific genetic variants is reported, a medical professional can take one or more actions that can affect subject care. For example, a medical professional can record information in the subject's medical record regarding the subject's risk of developing a developmental disorder. In some embodiments, a medical professional can record information regarding risk assessment, or otherwise transform the subject's medical record, to reflect the subject's current medical condition. In some embodiments, a medical professional can review and evaluate a subject's entire medical record and assess multiple treatment strategies for clinical intervention of a subject's condition.

A medical professional can initiate or modify treatment after receiving information regarding a subject's screening of a developmental disorder, for example. In some embodiments, a medical professional can recommend a change in therapy. In some embodiments, a medical professional can enroll a subject in a clinical trial for, by way of example, detecting correlations between a haplotype as described herein and any measurable or quantifiable parameter relating to the outcome of the treatment as described above.

In some embodiments, a medical professional can communicate information regarding a subject's screening of developing a developmental disorder to a subject or a subject's family. In some embodiments, a medical professional can provide a subject and/or a subject's family with information regarding a developmental disorder and risk assessment information, including treatment options, and referrals to specialists. In some embodiments, a medical professional can provide a copy of a subject's medical records to a specialist. In some embodiments, a research professional can apply information regarding a subject's risk of developing a developmental disorder to advance scientific research. In some embodiments, a research professional can obtain a subject's haplotype as described herein to evaluate a subject's enrollment, or continued participation, in a research study or clinical trial. In some embodiments, a research professional can communicate information regarding a subject's screening of a developmental disorder to a medical professional. In some embodiments, a research professional can refer a subject to a medical professional.

Any appropriate method can be used to communicate information to another person. For example, information can be given directly or indirectly to a professional and laboratory technician can input a subject's genetic variation as described herein into a computer-based record. In some embodiments, information is communicated by making a physical alteration to medical or research records. For example, a medical professional can make a permanent notation or flag a medical record for communicating the risk assessment to other medical professionals reviewing the record. In addition, any type of communication can be used to communicate the risk assessment information. For example, mail, e-mail, telephone, and face-to-face interactions can be used. The information also can be communicated to a professional by making that information electronically available to the professional. For example, the information can be communicated to a professional by placing the information on a computer database such that the professional can access the information. In addition, the information can be communicated to a hospital, clinic, or research facility serving as an agent for the professional.

Results of these tests, and optionally interpretive information, can be returned to the subject, the health care provider or to a third party. The results can be communicated to the tested subject, for example, with a prognosis and optionally interpretive materials that can help the subject understand the test results and prognosis; used by a health care provider, for example, to determine whether to administer a specific drug, or whether a subject should be assigned to a specific category, for example, a category associated with a specific disease endophenotype, or with drug response or non-response; used by a third party such as a healthcare payer, for example, an insurance company or HMO, or other agency, to determine whether or not to reimburse a health care provider for services to the subject, or whether to approve the provision of services to the subject. For example, the healthcare payer can decide to reimburse a health care provider for treatments for a developmental disorder if the subject has a developmental disorder or has an increased risk of developing a developmental disorder.

Also provided herein are databases that include a list of genetic variations as described herein, and wherein the list can be largely or entirely limited to genetic variations identified as useful for screening a developmental disorder as described herein. The list can be stored, for example, on a flat file or computer-readable medium. The databases can further include information regarding one or more subjects, for example, whether a subject is affected or unaffected, clinical information such as endophenotype, age of onset of symptoms, any treatments administered and outcomes, for example, data relevant to pharmacogenomics, diagnostics, prognostics or theranostics, and other details, for example, data about the disorder in the subject, or environmental or other genetic factors. The databases can be used to detect correlations between a particular haplotype and the information regarding the subject.

The methods described herein can also include the generation of reports for use, for example, by a subject, care giver, or researcher, that include information regarding a subject's genetic variations, and optionally further information such as treatments administered, treatment history, medical history, predicted response, and actual response. The reports can be recorded in a tangible medium, e.g., a computer-readable disk, a solid state memory device, or an optical storage device.

Methods of Screening Using Variations in Polypeptides

In another embodiment of the disclosure, screening of a developmental disorder can be made by examining or comparing changes in expression, localization, binding partners, and composition of a polypeptide encoded by a nucleic acid associated with a developmental disorder, for example, in those instances where the genetic variations of the present disclosure results in a change in the composition or expression of the polypeptide. Thus, screening of a developmental disorder can be made by examining expression and/or composition of one of these polypeptides, or another polypeptide encoded by a nucleic acid associated with a developmental disorder, in those instances where the genetic variation of the present disclosure results in a change in the expression, localization, binding partners, and/or composition of the polypeptide. In some embodiments, screening can comprise diagnosing a subject. In some embodiments, screening can comprise determining a prognosis of a subject, for example, determining the susceptibility of developing a developmental disorder. In some embodiments, screening can comprise theranosing a subject.

The genetic variations described herein that show association to a developmental disorder can play a role through their effect on one or more of these nearby genes. For example, while not intending to be limited by theory, it is generally expected that a deletion of a chromosomal segment comprising a particular gene, or a fragment of a gene, can either result in an altered composition or expression, or both, of the encoded protein. Likewise, duplications, or high number copy number variations, are in general expected to result in increased expression of encoded polypeptide. Other possible mechanisms affecting genes within a genetic variation region include, for example, effects on transcription, effects on RNA splicing, alterations in relative amounts of alternative splice forms of mRNA, effects on RNA stability, effects on transport from the nucleus to cytoplasm, and effects on the efficiency and accuracy of translation. Thus, DNA variations can be detected directly, using the subjects unamplified or amplied genomic DNA, or indirectly, using RNA or DNA obtained from the subject's tissue(s) that are present in an aberrant form or expression level as a result of the genetic variations of the disclosure showing association to ASD.

In some embodiments, the genetic variations of the disclosure showing association to a developmental disorder can affect the expression of a gene within the genetic variation region. In some embodiments, a genetic variation affecting an exonic region of a gene can affect, disrupt, or modulate the expression of the gene. In some embodiments, a genetic variation affecting an intergenic region of a gene can affect, disrupt, or modulate the expression of the gene. Certain genetic variation regions can have flanking duplicated segments, and genes within such segments can have altered expression and/or composition as a result of such genomic alterations. Regulatory elements affecting gene expression can be located far away, even as far as tens or hundreds of kilobases away, from the promoter region of a gene. Thus, in some embodiments, regulatory elements for genes that are located outside the genetic variation region can be located within the genetic variation, and can be affected by the genetic variation. It is thus contemplated that the detection of the genetic variations described herein, can be used for assessing expression for one or more of associated genes not directly impacted by the genetic variations. In some embodiments, a genetic variation affecting an intergenic region of a gene can affect, disrupt, or modulate the expression of a gene located elsewhere in the genome, such as described above. For example, a genetic variation affecting an intergenic region of a gene can affect, disrupt, or modulate the expression of a transcription factor, located elsewhere in the genome, which regulates the gene.

In some embodiments, genetic variations of the disclosure showing association to ASD can affect protein expression at the translational level. It can be appreciated by those skilled in the art that this can occur by increased or decreased expression of one or more microRNAs (miRNAs) that regulates expression of a protein known to be important, or implicated, in the cause, onset, or progression of ASD. Increased or decreased expression of the one or more miRNAs can result from gain or loss of the whole miRNA gene, disruption of a portion of the gene (e.g., by an indel or CNV), or even a single base change (SNP or SNV) that produces an altered, non-functional or aberrant functioning miRNA sequence. It can also be appreciated by those skilled in the art that the expression of protein, for example, one known to cause ASD by increased or decreased expression, can result due to a genetic variation that results in alteration of an existing miRNA binding site within the protein's mRNA transcript, or even creates a new miRNA binding site that leads to aberrant protein expression.

A variety of methods can be used for detecting protein composition and/or expression levels, including but not limited to enzyme linked immunosorbent assays (ELISA), Western blots, spectroscopy, mass spectrometry, peptide arrays, colorimetry, electrophoresis, isoelectric focusing, immunoprecipitations, immunoassays, and immunofluorescence and other methods well-known in the art. A test sample from a subject can be assessed for the presence of an alteration in the expression and/or an alteration in composition of the polypeptide encoded by a nucleic acid associated with a developmental disorder. An "alteration" in the polypeptide expression or composition, as used herein, refers to an alteration in expression or composition in a test sample, as compared to the expression or composition of the polypeptide in a control sample. Such alteration can, for example, be an alteration in the quantitative polypeptide expression or can be an alteration in the qualitative polypeptide expression, for example, expression of a mutant polypeptide or of a different splicing variant, or a combination thereof. In some embodiments, screening of a developmental disorder can be made by detecting a particular splicing variant encoded by a nucleic acid associated with a developmental disorder, or a particular pattern of splicing variants.

Antibodies can be polyclonal or monoclonal and can be labeled or unlabeled. An intact antibody, or a fragment thereof can be used. The term "labeled", with regard to the probe or antibody, is intended to encompass direct labeling of the probe or antibody by coupling a detectable substance to the probe or antibody, as well as indirect labeling of the probe or antibody by reactivity with another reagent that is directly labeled as previously described herein. Other non-limiting examples of indirect labeling include detection of a primary antibody using a labeled secondary antibody, for example, a fluorescently-labeled secondary antibody and end-labeling of a DNA probe with biotin such that it can be detected with fluorescently-labeled streptavidin.

Detecting Genetic Variations Associated with Autism Spectrum Disorder

Described herein, are methods that can be used to detect genetic variations. Detecting specific genetic variations, for example, polymorphic markers and/or haplotypes, copy number, absence or presence of an allele, or genotype associated with a developmental disorder as described herein, can be accomplished by methods known in the art for analyzing nucleic acids and/or detecting sequences at polymorphic or genetically variable sites, for example, amplification techniques, hybridization techniques, sequencing, arrays, or any combination thereof. Thus, by use of these methods disclosed herein or other methods available to the person skilled in the art, one or more alleles at polymorphic markers, including microsatellites, SNPs, CNVs, or other types of genetic variations, can be identified in a sample obtained from a subject.

Nucleic Acids

The nucleic acids and polypeptides described herein can be used in methods and kits of the present disclosure. In some embodiments, aptamers that specifically bind the nucleic acids and polypeptides described herein can be used in methods and kits of the present disclosure. As used herein, a nucleic acid can comprise a deoxyribonucleotide (DNA) or ribonucleotide (RNA), whether singular or in polymers, naturally occurring or non-naturally occurring, double-stranded or single-stranded, coding, for example, a translated gene, or non-coding, for example, a regulatory region, or any fragments, derivatives, mimetics or complements thereof. In some embodiments, nucleic acids can comprise oligonucleotides, nucleotides, polynucleotides, nucleic acid sequences, genomic sequences, antisense nucleic acids, DNA regions, probes, primers, genes, regulatory regions, introns, exons, open-reading frames, binding sites, target nucleic acids and allele-specific nucleic acids.

"Isolated" nucleic acids, as used herein, are separated from nucleic acids that normally flank the gene or nucleotide sequence (as in genomic sequences) and/or has been completely or partially purified from other transcribed sequences (e.g., as in an RNA library). For example, isolated nucleic acids of the disclosure can be substantially isolated with respect to the complex cellular milieu in which it naturally occurs, or culture medium when produced by recombinant techniques, or chemical precursors or other chemicals when chemically synthesized. In some instances, the isolated material can form part of a composition, for example, a crude extract containing other substances, buffer system or reagent mix. In some embodiments, the material can be purified to essential homogeneity using methods known in the art, for example, by polyacrylamide gel electrophoresis (PAGE) or column chromatography (e.g., HPLC). With regard to genomic DNA (gDNA), the term "isolated" also can refer to nucleic acids that are separated from the chromosome with which the genomic DNA is naturally associated. For example, the isolated nucleic acid molecule can contain less than about 250 kb, 200 kb, 150 kb, 100 kb, 75 kb, 50 kb, 25 kb, 10 kb, 5 kb, 4 kb, 3 kb, 2 kb, 1 kb, 0.5 kb or 0.1 kb of the nucleotides that flank the nucleic acid molecule in the gDNA of the cell from which the nucleic acid molecule is derived.

Nucleic acids can be fused to other coding or regulatory sequences can be considered isolated. For example, recombinant DNA contained in a vector is included in the definition of "isolated" as used herein. In some embodiments, isolated nucleic acids can include recombinant DNA molecules in heterologous host cells or heterologous organisms, as well as partially or substantially purified DNA molecules in solution. Isolated nucleic acids also encompass in vivo and in vitro RNA transcripts of the DNA molecules of the present disclosure. An isolated nucleic acid molecule or nucleotide sequence can be synthesized chemically or by recombinant means. Such isolated nucleotide sequences can be useful, for example, in the manufacture of the encoded polypeptide, as probes for isolating homologous sequences (e.g., from other mammalian species), for gene mapping (e.g., by in situ hybridization with chromosomes), or for detecting expression of the gene, in tissue (e.g., human tissue), such as by Northern blot analysis or other hybridization techniques disclosed herein. The disclosure also pertains to nucleic acid sequences that hybridize under high stringency hybridization conditions, such as for selective hybridization, to a nucleotide sequence described herein. Such nucleic acid sequences can be detected and/or isolated by allele- or sequence-specific hybridization (e.g., under high stringency conditions). Stringency conditions and methods for nucleic acid hybridizations are well known to the skilled person (see, e.g., Current Protocols in Molecular Biology, Ausubel, F. et al., John Wiley & Sons, (1998), and Kraus, M. and Aaronson, S., Methods Enzymol., 200:546-556 (1991), the entire teachings of which are incorporated by reference herein.

Calculations of "identity" or "percent identity" between two or more nucleotide or amino acid sequences can be determined by aligning the sequences for optimal comparison purposes (e.g., gaps can be introduced in the sequence of a first sequence). The nucleotides at corresponding positions are then compared, and the percent identity between the two sequences is a function of the number of identical positions shared by the sequences (i.e., % identity=# of identical positions/total # of positions×100). For example, a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences. In some embodiments, the length of a sequence aligned for comparison purposes is at least 30%, at least 40%, at least 50%, at least 60%, at least 70%, at least 80%, at least 90%, or at least 95%, of the length of the reference sequence. The actual comparison of the two sequences can be accomplished by well-known methods, for example, using a mathematical algorithm. A non-limiting example of such a mathematical algorithm is described in Karlin, S. and Altschul, S., Proc. Natl. Acad. Sci. USA, 90-5873-5877 (1993). Such an algorithm is incorporated into the NBLAST and XBLAST programs (version 2.0), as described in Altschul, S. et al., Nucleic Acids Res., 25:3389-3402 (1997). When utilizing BLAST and Gapped BLAST programs, any relevant parameters of the respective programs (e.g., NBLAST) can be used. For example, parameters for sequence comparison can be set at score=100, word length=12, or can be varied (e.g., W=5 or W=20). Other examples include the algorithm of Myers and Miller, CABIOS (1989), ADVANCE, ADAM, BLAT, and FASTA. In another embodiment, the percent identity between two amino acid sequences can be accomplished using, for example, the GAP program in the GCG software package (Accelrys, Cambridge, UK).

"Probes" or "primers" can be oligonucleotides that hybridize in a base-specific manner to a complementary strand of a nucleic acid molecule. Probes can include primers, which can be a single-stranded oligonucleotide probe that can act as a point of initiation of template-directed DNA synthesis using methods including but not limited to, polymerase chain reaction (PCR) and ligase chain reaction (LCR) for amplification of a target sequence. Oligonucleotides, as described herein, can include segments or fragments of nucleic acid sequences, or their complements. In some embodiments, DNA segments can be between 5 and 10,000 contiguous bases, and can range from 5, 10, 12, 15, 20, or 25 nucleotides to 10, 15, 20, 25, 30, 40, 50, 100, 200, 500, 1000 or 10,000 nucleotides. In addition to DNA and RNA, probes and primers can include polypeptide nucleic acids (PNA), as described in Nielsen, P. et al., Science 254: 1497-1500 (1991). A probe or primer can comprise a region of nucleotide sequence that hybridizes to at least about 15, typically about 20-25, and in certain embodiments about 40, 50 or 75, consecutive nucleotides of a nucleic acid molecule.

The present disclosure also provides isolated nucleic acids, for example, probes or primers, that contain a fragment or portion that can selectively hybridize to a nucleic acid that comprises, or consists of, a nucleotide sequence, wherein the nucleotide sequence can comprise at least one polymorphism or polymorphic allele contained in the genetic variations described herein or the wild-type nucleotide that is located at the same position, or the compliments thereof. In some embodiments, the probe or primer can be at least 70% identical, at least 80% identical, at least 85% identical, at least 90% identical, or at least 95% identical, to the contiguous nucleotide sequence or to the complement of the contiguous nucleotide sequence.

In a preferred embodiment, a nucleic acid probe can be an oligonucleotide capable of hybridizing with a complementary regions of a gene associated with a developmental disorder containing a genetic variation described herein. The nucleic acid fragments of the disclosure can be used as probes or primers in assays such as those described herein.

The nucleic acids of the disclosure, such as those described above, can be identified and isolated using standard molecular biology techniques well known to the skilled person. In some embodiments, DNA can be amplified and/or can be labeled (e.g., radiolabeled, fluorescently labeled) and used as a probe for screening, for example, a cDNA library derived from an organism. cDNA can be derived from mRNA and can be contained in a suitable vector. For example, corresponding clones can be isolated, DNA obtained fallowing in vivo excision, and the cloned insert can be sequenced in either or both orientations by art-recognized methods to identify the correct reading frame encoding a polypeptide of the appropriate molecular weight. Using these or similar methods, the polypeptide and the DNA encoding the polypeptide can be isolated, sequenced and further characterized.

In some embodiments, nucleic acid can comprise one or more polymorphisms, variations, or mutations, for example, single nucleotide polymorphisms (SNPs), copy number variations (CNVs), for example, insertions, deletions, inversions, and translocations. In some embodiments, nucleic acids can comprise analogs, for example, phosphorothioates, phosphoramidates, methyl phosphonate, chiralmethyl phosphonates, 2-0-methyl ribonucleotides, or modified nucleic acids, for example, modified backbone residues or linkages, or nucleic acids combined with carbohydrates, lipids, protein or other materials, or peptide nucleic acids (PNAs), for example, chromatin, ribosomes, and transcriptosomes. In some embodiments nucleic acids can comprise nucleic acids in various structures, for example, A DNA, B DNA, Z-form DNA, siRNA, tRNA, and ribozymes. In some embodiments, the nucleic acid may be naturally or non-naturally polymorphic, for example, having one or more sequence differences, for example, additions, deletions and/or substitutions, as compared to a reference sequence. In some embodiments, a reference sequence can be based on publicly available information, for example, the U.C. Santa Cruz Human Genome Browser Gateway (genome.ucsc.edu/cgi-bin/hg-Gateway) or the NCBI website (www.ncbi.nlm.nih.gov). In another embodiment, a reference sequence can be determined by a practitioner of the present invention using methods well known in the art, for example, by sequencing a reference nucleic acid.

In some embodiment a probe can hybridize to an allele, SNP, or CNV as described herein. In some embodiments, the probe can bind to another marker sequence associated with a developmental disorder as described herein.

One of skill in the art would know how to design a probe so that sequence specific hybridization will occur only if a particular allele is present in a genomic sequence from a test sample. The disclosure can also be reduced to practice using any convenient genotyping method, including commercially available technologies and methods for genotyping particular genetic variations Control probes can also be used, for example, a probe that binds a less variable sequence, for example, a repetitive DNA associated with a centromere of a chromosome, can be used as a control. In some embodiments, probes can be obtained from commercial sources. In some embodiments, probes can be synthesized, for example, chemically or in vitro, or made from chromosomal or genomic DNA through standard techniques. In some embodiments sources of DNA that can be used include genomic DNA, cloned DNA sequences, somatic cell hybrids that contain one, or a part of one, human chromosome along with the normal chromosome complement of the host, and chromosomes purified by flow cytometry or microdissection. The region of interest can be isolated through cloning, or by site-specific amplification using PCR.

One or more nucleic acids for example, a probe or primer, can also be labeled, for example, by direct labeling, to comprise a detectable label. A detectable label can comprise any label capable of detection by a physical, chemical, or a biological process for example, a radioactive label, such as $^{32}P$ or $^{3}H$, a fluorescent label, such as FITC, a chromophore label, an affinity-ligand label, an enzyme label, such as alkaline phosphatase, horseradish peroxidase, or I2 galactosidase, an enzyme cofactor label, a hapten conjugate label, such as digoxigenin or dinitrophenyl, a Raman signal generating label, a magnetic label, a spin label, an epitope label, such as the FLAG or HA epitope, a luminescent label, a heavy atom label, a nanoparticle label, an electrochemical label, a light scattering label, a spherical shell label, semiconductor nanocrystal label, such as quantum dots (described in U.S. Pat. No. 6,207,392), and probes labeled with any other signal generating label known to those of skill in the art, wherein a label can allow the probe to be visualized with or without a secondary detection molecule. A nucleotide can be directly incorporated into a probe with standard techniques, for example, nick translation, random priming, and PCR labeling.

Non-limiting examples of label moieties useful for detection in the invention include, without limitation, suitable enzymes such as horseradish peroxidase, alkaline phosphatase, beta-galactosidase, or acetylcholinesterase; members of a binding pair that are capable of forming complexes such as streptavidin/biotin, avidin/biotin or an antigen/antibody complex including, for example, rabbit IgG and anti-rabbit IgG; fluorophores such as umbelliferone, fluorescein, fluorescein isothiocyanate, rhodamine, tetramethyl rhodamine, eosin, green fluorescent protein, erythrosin, coumarin, methyl coumarin, pyrene, malachite green, stilbene, lucifer yellow, Cascade Blue, Texas Red, dichlorotriazinylamine fluorescein, dansyl chloride, phycoerythrin, fluorescent lanthanide complexes such as those including Europium and Terbium, cyanine dye family members, such as Cy3 and Cy5, molecular beacons and fluorescent derivatives thereof, as well as others known in the art as described, for example, in Principles of Fluorescence Spectroscopy, Joseph R. Lakowicz (Editor), Plenum Pub Corp, 2nd edition (July 1999) and the 6th Edition of the Molecular Probes Handbook by Richard P. Hoagland; a luminescent material such as luminol; light scattering or plasmon resonant materials such as gold or silver particles or quantum dots; or radioactive material include $^{14}C$, $^{123}I$, $^{124}I$, $^{125}I$, Tc99m, $^{32}P$, $^{33}P$, $^{35}S$ or $^{3}H$.

Other labels can also be used in the methods of the present disclosure, for example, backbone labels. Backbone labels comprise nucleic acid stains that bind nucleic acids in a sequence independent manner. Non-limiting examples include intercalating dyes such as phenanthridines and acridines (e.g., ethidium bromide, propidium iodide, hexidium iodide, dihydroethidium, ethidium homodimer-1 and -2, ethidium monoazide, and ACMA); some minor grove binders such as indoles and imidazoles (e.g., Hoechst 33258, Hoechst 33342, Hoechst 34580 and DAPI); and miscellaneous nucleic acid stains such as acridine orange (also capable of intercalating), 7-AAD, actinomycin D, LDS751, and hydroxystilbamidine. All of the aforementioned nucleic acid stains are commercially available from suppliers such as Molecular Probes, Inc. Still other examples of nucleic acid stains include the following dyes from Molecular Probes: cyanine dyes such as SYTOX Blue, SYTOX Green, SYTOX Orange, POPO-1, POPO-3, YOYO-1, YOYO-3, TOTO-1, TOTO-3, JOJO-1, LOLO-1, BOBO-1, BOBO-3, PO-PRO-1, PO-PRO-3, BO-PRO-1, BO-PRO-3, TO-PRO-1, TO-PRO-3, TO-PRO-5, JO-PRO-1, LO-PRO-1, YO-PRO-1, YO-PRO-3, PicoGreen, OliGreen, RiboGreen, SYBR Gold, SYBR Green I, SYBR Green II, SYBR DX, SYTO-40, -41, -42, -43, -44, -45 (blue), SYTO-13, -16, -24, -21, -23, -12, -11, -20, -22, -15, -14, -25 (green), SYTO-81, -80, -82, -83, -84, -85 (orange), SYTO-64, -17, -59, -61, -62, -60, -63 (red).

In some embodiments, fluorophores of different colors can be chosen, for example, 7-amino-4-methylcoumarin-3-acetic acid (AMCA), 5-(and-6)-carboxy-X-rhodamine, lissamine rhodamine B, 5-(and-6)-carboxyfluorescein, fluorescein-5-isothiocyanate (FITC), 7-diethylaminocoumarin-3-carboxylic acid, tetramethylrhodamine-5-(and-6)-isothiocyanate, 5-(and-6)-carboxytetramethylrhodamine, 7-hydroxycoumarin-3-carboxylic acid, 6-[fluorescein 5-(and-6)-carboxamido]hexanoic acid, N-(4,4-difluoro-5,7-dimethyl-4-bora-3a,4a diaza-3-indacenepropionic acid, eosin-5-isothiocyanate, erythrosin-5-isothiocyanate, TRITC, rhodamine, tetramethylrhodamine, R-phycoerythrin, Cy-3, Cy-5, Cy-7, Texas Red, Phar-Red, allophycocyanin (APC), and CASCADE™ blue acetylazide, such that each probe in or not in a set can be distinctly visualized. In some embodiments, fluorescently labeled probes can be viewed with a fluorescence microscope and an appropriate filter for each fluorophore, or by using dual or triple bandpass filter sets to observe multiple fluorophores. In some embodiments, techniques such as flow cytometry can be used to examine the hybridization pattern of the probes.

In other embodiments, the probes can be indirectly labeled, for example, with biotin or digoxygenin, or labeled with radioactive isotopes such as $^{32}P$ and/or $^{3}H$. As a non-limiting example, a probe indirectly labeled with biotin can be detected by avidin conjugated to a detectable marker. For example, avidin can be conjugated to an enzymatic marker such as alkaline phosphatase or horseradish peroxidase. In some embodiments, enzymatic markers can be detected using colorimetric reactions using a substrate and/or a catalyst for the enzyme. In some embodiments, catalysts for alkaline phosphatase can be used, for example, 5-bromo-4-chloro-3-indolylphosphate and nitro blue tetrazolium. In some embodiments, a catalyst can be used for horseradish peroxidase, for example, diaminobenzoate.

Methods of Detecting Genetic Variations

In some embodiments, standard techniques for genotyping for the presence genetic variations, for example, amplification, can be used. Amplification of nucleic acids can be accomplished using methods known in the art. Generally, sequence information from the region of interest can be used to design oligonucleotide primers that can be identical or similar in sequence to opposite strands of a template to be amplified. In some embodiments, amplification methods can include but are not limited to, fluorescence-based techniques utilizing PCR, for example, ligase chain reaction (LCR), Nested PCR, transcription amplification, self-sustained sequence replication, and nucleic acid based sequence amplification (NASBA), and multiplex ligation-dependent probe amplification (MLPA). Guidelines for selecting primers for PCR amplification are well known in the art. In some embodiments, a computer program can be used to design primers, for example, Oligo (National Biosciences, Inc, Plymouth Minn.), MacVector (Kodak/IBI), and GCG suite of sequence analysis programs.

In some embodiments, commercial methodologies available for genotyping, for example, SNP genotyping, can be used, but are not limited to, TaqMan genotyping assays (Applied Biosystems), SNPlex platforms (Applied Biosystems), gel electrophoresis, capillary electrophoresis, size exclusion chromatography, mass spectrometry, for example, MassARRAY system (Sequenom), minisequencing methods, real-time Polymerase Chain Reaction (PCR), Bio-Plex system (BioRad), CEQ and SNPstream systems (Beckman), array hybridization technology, for example, Affymetrix GeneChip (Perlegen), BeadArray Technologies, for example, Illumina GoldenGate and Infinium assays, array tag technology, Multiplex Ligation-dependent Probe Amplification (MLPA), and endonuclease-based fluorescence hybridization technology (Invader; Third Wave). PCR can be a procedure in which target nucleic acid is amplified in a manner similar to that described in U.S. Pat. No. 4,683,195 and subsequent modifications of the procedure described therein. In some embodiments, real-time quantitative PCR can be used to determine genetic variations, wherein quantitative PCR can permit both detection and quantification of a DNA sequence in a sample, for example, as an absolute number of copies or as a relative amount when normalized to DNA input or other normalizing genes. In some embodiments, methods of quantification can include the use of fluorescent dyes that can intercalate with double-stranded DNA, and modified DNA oligonucleotide probes that can fluoresce when hybridized with a complementary DNA.

In some embodiments of the disclosure, a sample containing genomic DNA obtained from the subject can be collected and PCR can used to amplify a fragment of nucleic acid that comprises one or more genetic variations that can be indicative of a susceptibility to a developmental disorder. In another embodiment, detection of genetic variations can be accomplished by expression analysis, for example, by using quantitative PCR. In some embodiments, this technique can assess the presence of an alteration in the expression or composition of one or more polypeptides or splicing variants encoded by a nucleic acid associated with a developmental disorder.

In a preferred embodiment, the DNA template of a sample from a subject containing a SNP can be amplified by PCR prior to detection with a probe. In such an embodiment, the amplified DNA serves as the template for a detection probe and, in some embodiments, an enhancer probe. Certain embodiments of the detection probe, the enhancer probe, and/or the primers used for amplification of the template by PCR can comprise the use of modified bases, for example, modified A, T, C, G, and U, wherein the use of modified bases can be useful for adjusting the melting temperature of the nucleotide probe and/or primer to the template DNA. In a preferred embodiment, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In some embodiments, identification of genetic variations can be accomplished using hybridization methods. The presence of a specific marker allele or a particular genomic segment comprising a genetic variation, or representative of a genetic variation, can be indicated by sequence-specific hybridization of a nucleic acid probe specific for the particular allele or the genetic variation in a nucleic acid containing sample that has or has not been amplified but methods described herein. The presence of more than one specific marker allele or several genetic variations can be indicated by using two or more sequence-specific nucleic acid probes, wherein each is specific for a particular allele and/or genetic variation.

Hybridization can be performed by methods well known to the person skilled in the art, for example, hybridization techniques such as fluorescent in situ hybridization (FISH), Southern analysis, Northern analysis, or in situ hybridization. In some embodiments, hybridization refers to specific hybridization, wherein hybridization can be performed with no mismatches. Specific hybridization, if present, can be using standard methods. In some embodiments, if specific hybridization occurs between a nucleic acid probe and the nucleic acid in the sample, the sample can contain a sequence that can be complementary to a nucleotide present in the nucleic acid probe. In some embodiments, if a nucleic acid probe can contain a particular allele of a polymorphic marker, or particular alleles for a plurality of markers, specific hybridization is indicative of the nucleic acid being completely complementary to the nucleic acid probe, including the particular alleles at polymorphic markers within the probe. In some embodiments a probe can contain more than one marker alleles of a particular haplotype, for example, a probe can contain alleles complementary to 2, 3, 4, 5 or all of the markers that make up a particular haplotype. In some embodiments detection of one or more particular markers of the haplotype in the sample is indicative that the source of the sample has the particular haplotype.

In some embodiments, PCR conditions and primers can be developed that amplify a product only when the variant allele is present or only when the wild type allele is present, for example, allele-specific PCR. In some embodiments of allele-specific PCR, a method utilizing a detection oligonucleotide probe comprising a fluorescent moiety or group at its 3' terminus and a quencher at its 5' terminus, and an enhancer oligonucleotide, can be employed, as described by Kutyavin et al. (Nucleic Acid Res. 34:e128 (2006)).

An allele-specific primer/probe can be an oligonucleotide that is specific for particular a polymorphism can be prepared using standard methods. In some embodiments, allele-specific oligonucleotide probes can specifically hybridize to a nucleic acid region that contains a genetic variation. In some embodiments, hybridization conditions can be selected such that a nucleic acid probe can specifically bind to the sequence of interest, for example, the variant nucleic acid sequence.

In some embodiments, allele-specific restriction digest analysis can be used to detect the existence of a polymorphic variant of a polymorphism, if alternate polymorphic variants of the polymorphism can result in the creation or elimination of a restriction site. Allele-specific restriction digests can be performed, for example, with the particular restriction enzyme that can differentiate the alleles. In some embodiments, PCR can be used to amplify a region comprising the polymorphic site, and restriction fragment length polymorphism analysis can be conducted. In some embodiments, for sequence variants that do not alter a common restriction site, mutagenic primers can be designed that can introduce one or more restriction sites when the variant allele is present or when the wild type allele is present.

In some embodiments, fluorescence polarization template-directed dye-terminator incorporation (FP-TDI) can be used to determine which of multiple polymorphic variants of a polymorphism can be present in a subject. Unlike the use of allele-specific probes or primers, this method can employ primers that can terminate adjacent to a polymorphic site, so that extension of the primer by a single nucleotide can result in incorporation of a nucleotide complementary to the polymorphic variant at the polymorphic site.

In some embodiments, DNA containing an amplified portion can be dot-blotted, using standard methods and the blot contacted with the oligonucleotide probe. The presence of specific hybridization of the probe to the DNA can then be detected. The methods can include determining the genotype of a subject with respect to both copies of the polymorphic site present in the genome, wherein if multiple polymorphic variants exist at a site, this can be appropriately indicated by specifying which variants are present in a subject. Any of the detection means described herein can be used to determine the genotype of a subject with respect to one or both copies of the polymorphism present in the subject's genome.

In some embodiments, a peptide nucleic acid (PNA) probe can be used in addition to, or instead of, a nucleic acid probe in the methods described herein. A PNA can be a DNA mimic having a peptide-like, inorganic backbone, for example, N-(2-aminoethyl) glycine units with an organic base (A, G, C, T or U) attached to the glycine nitrogen via a methylene carbonyl linker.

Nucleic acid sequence analysis can also be used to detect genetic variations, for example, genetic variations can be detected by sequencing exons, introns, 5' untranslated sequences, or 3' untranslated sequences. One or more methods of nucleic acid analysis that are available to those skilled in the art can be used to detect genetic variations, including but not limited to, direct manual sequencing, automated fluorescent sequencing, single-stranded conformation polymorphism assays (SSCP); clamped denaturing gel electrophoresis (CDGE); denaturing gradient gel electrophoresis (DGGE), two-dimensional gel electrophoresis (2DGE or TDGE); conformational sensitive gel electrophoresis (CSGE); denaturing high performance liquid chromatography (DHPLC), infrared matrix-assisted laser desorption/ionization (IR-MALDI) mass spectrometry, mobility shift analysis, quantitative real-time PCR, restriction enzyme analysis, heteroduplex analysis; chemical mismatch cleavage (CMC), RNase protection assays, use of polypeptides that recognize nucleotide mismatches, allele-specific PCR, real-time pyrophosphate DNA sequencing, PCR amplification in combination with denaturing high performance liquid chromatography (dHPLC), and combinations of such methods.

Sequencing can be accomplished through classic Sanger sequencing methods, which are known in the art. In a preferred embodiment sequencing can be performed using high-throughput sequencing methods some of which allow detection of a sequenced nucleotide immediately after or upon its incorporation into a growing strand, for example, detection of sequence in substantially real time or real time. In some cases, high throughput sequencing generates at least 1,000, at least 5,000, at least 10,000, at least 20,000, at least 30,000, at least 40,000, at least 50,000, at least 100,000 or at least 500,000 sequence reads per hour; with each read being at least 50, at least 60, at least 70, at least 80, at least 90, at least 100, at least 120 or at least 150 bases per read (or 500-1,000 bases per read for 454).

High-throughput sequencing methods can include but are not limited to, Massively Parallel Signature Sequencing (MPSS, Lynx Therapeutics), Polony sequencing, 454 pyrosequencing, Illumina (Solexa) sequencing, SOLiD sequencing, on semiconductor sequencing, DNA nanoball sequencing, Helioscope™ single molecule sequencing, Single Molecule SMRT™ sequencing, Single Molecule real time (RNAP) sequencing, Nanopore DNA sequencing, and/or sequencing by hybridization, for example, a non-enzymatic method that uses a DNA microarray, or microfluidic Sanger sequencing.

In some embodiments, high-throughput sequencing can involve the use of technology available by Helicos BioSciences Corporation (Cambridge, Mass.) such as the Single Molecule Sequencing by Synthesis (SMSS) method. SMSS is unique because it allows for sequencing the entire human genome in up to 24 hours. This fast sequencing method also allows for detection of a SNP/nucleotide in a sequence in substantially real time or real time. Finally, SMSS is powerful because, like the MIP technology, it does not use a pre-amplification step prior to hybridization. SMSS does not use any amplification. SMSS is described in US Publication Application Nos. 20060024711; 20060024678; 20060012793; 20060012784; and 20050100932. In some embodiments, high-throughput sequencing involves the use of technology available by 454 Life Sciences, Inc. (a Roche company, Branford, Conn.) such as the PicoTiterPlate device which includes a fiber optic plate that transmits chemiluminescent signal generated by the sequencing reaction to be recorded by a CCD camera in the instrument. This use of fiber optics allows for the detection of a minimum of 20 million base pairs in 4.5 hours.

In some embodiments, PCR-amplified single-strand nucleic acid can be hybridized to a primer and incubated with a polymerase, ATP sulfurylase, luciferase, apyrase, and the substrates luciferin and adenosine 5' phosphosulfate. Next, deoxynucleotide triphosphates corresponding to the bases A, C, G, and T (U) can be added sequentially. A base incorporation can be accompanied by release of pyrophosphate, which can be converted to ATP by sulfurylase, which can drive synthesis of oxyluciferin and the release of visible light. Since pyrophosphate release can be equimolar with the number of incorporated bases, the light given off can be proportional to the number of nucleotides adding in any one step. The process can repeat until the entire sequence can be determined. In some embodiments, pyrosequencing can be utilized to analyze amplicons to determine whether breakpoints are present. In another embodiment, pyrosequencing can map surrounding sequences as an internal quality control.

Pyrosequencing analysis methods are known in the art. Sequence analysis can include a four-color sequencing by ligation scheme (degenerate ligation), which involves hybridizing an anchor primer to one of four positions. Then an enzymatic ligation reaction of the anchor primer to a population of degenerate nonamers that are labeled with fluorescent dyes can be performed. At any given cycle, the population of nonamers that is used can be structured such that the identity of one of its positions can be correlated with the identity of the fluorophore attached to that nonamer. To the extent that the ligase discriminates for complementarily at that queried position, the fluorescent signal can allow the inference of the identity of the base. After performing the ligation and four-color imaging, the anchor primer: nonamer complexes can be stripped and a new cycle begins. Methods to image sequence information after performing ligation are known in the art.

In some embodiments, analysis by restriction enzyme digestion can be used to detect a particular genetic variation if the genetic variation results in creation or elimination of one or more restriction sites relative to a reference sequence. In some embodiments, restriction fragment length polymorphism (RFLP) analysis can be conducted, wherein the digestion pattern of the relevant DNA fragment indicates the presence or absence of the particular genetic variation in the sample.

In some embodiments, arrays of oligonucleotide probes that can be complementary to target nucleic acid sequence segments from a subject can be used to identify genetic variations. In some embodiments, an array of oligonucleotide probes comprises an oligonucleotide array, for example, a microarray. In some embodiments, the present disclosure features arrays that include a substrate having a plurality of addressable areas, and methods of using them. At least one area of the plurality includes a nucleic acid probe that binds specifically to a sequence comprising a genetic variation, and can be used to detect the absence or presence of said genetic variation, for example, one or more SNPs, microsatellites, or CNVs, as described herein, to determine or identify an allele or genotype. For example, the array can include one or more nucleic acid probes that can be used to detect a genetic variation such as those listed in Tables 1 and 5. In some embodiments, the array can further comprise at least one area that includes a nucleic acid probe that can be used to specifically detect another marker associated with a developmental disorder, for example, ASD, as described herein.

Microarray hybridization can be performed by hybridizing a nucleic acid of interest; for example, a nucleic acid encompassing a genetic variation, with the array and detecting hybridization using nucleic acid probes. In some embodiments, the nucleic acid of interest is amplified prior to hybridization. Hybridization and detecting can be carried out according to standard methods described in Published PCT Applications: WO 92/10092 and WO 95/11995, and U.S. Pat. No. 5,424,186. For example, an array can be scanned to determine the position on the array to which the nucleic acid hybridizes. The hybridization data obtained from the scan can be, for example, in the form of fluorescence intensities as a function of location on the array.

Arrays can be formed on substrates fabricated with materials such as paper; glass; plastic, for example, polypropylene, nylon, or polystyrene; polyacrylamide; nitrocellulose; silicon; optical fiber; or any other suitable solid or semisolid support; and can be configured in a planar, for example, glass plates or silicon chips); or three dimensional, for example, pins, fibers, beads, particles, microtiter wells, and capillaries, configuration.

Methods for generating arrays are known in the art and can include for example; photolithographic methods (U.S. Pat. Nos. 5,143,854, 5,510,270 and 5,527,681); mechanical methods, for example, directed-flow methods (U.S. Pat. No. 5,384,261); pin-based methods (U.S. Pat. No. 5,288,514); bead-based techniques (PCT US/93/04145); solid phase oligonucleotide synthesis methods; or by other methods known to a person skilled in the art (see, e.g., Bier, F. F., et al. Adv Biochem Eng Biotechnol 109:433-53 (2008); Hoheisel, J. D., Nat Rev Genet 7: 200-10 (2006); Fan, J. B., et al. Methods Enzymol 410:57-73 (2006); Raqoussis, J. & Elvidge, G., Expert Rev Mol Design 6: 145-52 (2006); Mockler, T. C., et al. Genomics 85: 1-15 (2005), and references cited therein, the entire teachings of each of which are incorporated by reference herein). Many additional descriptions of the preparation and use of oligonucleotide arrays for detection of polymorphisms can be found, for example, in U.S. Pat. Nos. 6,858,394, 6,429,027, 5,445,934, 5,700,637, 5,744,305, 5,945,334, 6,054,270, 6,300,063, 6,733,977, 7,364,858, EP 619 321, and EP 373 203, the entire teachings of which are incorporated by reference herein. Methods for array production, hybridization, and analysis are also described in Snijders et al., Nat. Genetics 29:263-264 (2001); Klein et al., Proc. Natl. Acad. Sci. USA 96:4494-4499 (1999); Albertson et al., Breast Cancer Research and Treatment 78:289-298 (2003); and Snijders et al., "BAC microarray based comparative genomic hybridization," in: Zhao et al. (eds), Bacterial Artificial Chromosomes Methods and Protocols, Methods in Molecular Biology, Humana Press, 2002.

In some embodiments, oligonucleotide probes forming an array can be attached to a substrate by any number of techniques, including, but not limited to, in situ synthesis, for example, high-density oligonucleotide arrays, using photolithographic techniques; spotting/printing a medium to low density on glass, nylon, or nitrocellulose; by masking; and by dot-blotting on a nylon or nitrocellulose hybridization membrane. In some embodiments, oligonucleotides can be immobilized via a linker, including but not limited to, by covalent, ionic, or physical linkage. Linkers for immobilizing nucleic acids and polypeptides, including reversible or cleavable linkers, are known in the art (U.S. Pat. No. 5,451,683 and WO98/20019). In some embodiments, oligonucleotides can be non-covalently immobilized on a substrate by hybridization to anchors, by means of magnetic beads, or in a fluid phase, for example, in wells or capillaries.

An array can comprise oligonucleotide hybridization probes capable of specifically hybridizing to different genetic variations. In some embodiments, oligonucleotide arrays can comprise a plurality of different oligonucleotide probes coupled to a surface of a substrate in different known locations. In some embodiments, oligonucleotide probes can exhibit differential or selective binding to polymorphic sites, and can be readily designed by one of ordinary skill in the art, for example, an oligonucleotide that is perfectly complementary to a sequence that encompasses a polymorphic site, for example, a sequence that includes the polymorphic site, within it, or at one end, can hybridize preferentially to a nucleic acid comprising that sequence, as opposed to a nucleic acid comprising an alternate polymorphic variant.

In some embodiments, arrays can include multiple detection blocks, for example, multiple groups of probes designed for detection of particular polymorphisms. In some embodiments, these arrays can be used to analyze multiple different polymorphisms. In some embodiments, detection blocks can be grouped within a single array or in multiple, separate arrays, wherein varying conditions, for example, conditions optimized for particular polymorphisms, can be used during hybridization. General descriptions of using oligonucleotide arrays for detection of polymorphisms can be found, for example, in U.S. Pat. Nos. 5,858,659 and 5,837,832. In addition to oligonucleotide arrays, cDNA arrays can be used similarly in certain embodiments.

The methods described herein can include but are not limited to providing an array as described herein; contacting the array with a sample, and detecting binding of a nucleic acid from the sample to the array. In some embodiments, the method can comprise amplifying nucleic acid from the sample, for example, a region associated with a developmental disorder or a region that includes another region associated with a developmental disorder. In some embodiments, the methods described herein can include using an array that can identify differential expression patterns or copy numbers of one or more genes in samples from control and affected individuals. For example, arrays of probes to a marker described herein can be used to identify genetic variations between DNA from an affected subject, and control DNA obtained from an individual that does not have a developmental disorder. Since the nucleotides on the array can contain sequence tags, their positions on the array can be accurately known relative to the genomic sequence.

In some embodiments, it can be desirable to employ methods that can detect the presence of multiple genetic variations, for example, polymorphic variants at a plurality of polymorphic sites, in parallel or substantially simultaneously. In some embodiments, these methods can comprise oligonucleotide arrays and other methods, including methods in which reactions, for example, amplification and hybridization, can be performed in individual vessels, for example, within individual wells of a multi-well plate or other vessel.

Determining the identity of a genetic variation can also include or consist of reviewing a subject's medical history, where the medical history includes information regarding the identity, copy number, presence or absence of one or more alleles or SNPs in the subject, e.g., results of a genetic test.

In some embodiments extended runs of homozygosity (ROH) may be useful to map recessive disease genes in outbred populations. Furthermore, even in complex disorders, a high number of affected individuals may have the same haplotype in the region surrounding a disease mutation. Therefore, a rare pathogenic variant and surrounding haplotype can be enriched in frequency in a group of affected individuals compared with the haplotype frequency in a cohort of unaffected controls. Homozygous haplotypes (HH) that are shared by multiple affected individuals can be important for the discovery of recessive disease genes in complex disorders such as ASD. In some embodiments, the traditional homozygosity mapping method can be extended by analysing the haplotype within shared ROH regions to identify homozygous segments of identical haplotype that are present uniquely or at a higher frequency in ASD probands compared to parental controls. Such regions are termed risk homozygous haplotypes (rHH), which may contain low-frequency recessive variants that contribute to ASD risk in a subset of ASD patients.

Genetic variations can also be identified using any of a number of methods well known in the art. For example, genetic variations available in public databases, which can be searched using methods and custom algorithms or algorithms known in the art, can be used. In some embodiments, a reference sequence can be from, for example, the human draft genome sequence, publicly available in various databases, or a sequence deposited in a database such as GenBank.

Methods of Detecting CNVs

Detection of genetic variations, specifically CNVs, can be accomplished by one or more suitable techniques described herein. Generally, techniques that can selectively determine whether a particular chromosomal segment is present or absent in an individual can be used for genotyping CNVs. Identification of novel copy number variations can be done by methods for assessing genomic copy number changes.

In some embodiments, methods include but are not limited to, methods that can quantitatively estimate the number of copies of a particular genomic segment, but can also include methods that indicate whether a particular segment is present in a sample or not. In some embodiments, the technique to be used can quantify the amount of segment present, for example, determining whether a DNA segment is deleted, duplicated, or triplicated in subject, for example, Fluorescent In Situ Hybridization (FISH) techniques, and other methods described herein. In some embodiments, methods include detection of copy number variation from array intensity and sequencing read depth using a stepwise Bayesian model (Zhang Z. D., et al. BMC Bioinformatics. 2010 Oct. 31; 11:539). In some embodiments, methods include detecting copy number variations using shotgun sequencing, CNV-seq (Xie C., et al. BMC Bioinformatics. 2009 Mar. 6; 10:80). In some embodiments, methods include analyzing next-generation sequencing (NGS) data for CNV detection using any one of several algorithms developed for each of the four broad methods for CNV detection using NGS, namely the depth of coverage (DOC), read-pair (RP), split-read (SR) and assembly-based (AS) methods. (Teo S. M., et al. Bioinformatics. 2012 Aug. 31). In some embodiments, methods include combining coverage with map information for the identification of deletions and duplications in targeted sequence data (Nord A. S., et al. BMC Genomics. 2011 Apr. 12; 12:184).

In some embodiments, other genotyping technologies can be used for detection of CNVs, including but not limited to, karyotype analysis, Molecular Inversion Probe array technology, for example, Affymetrix SNP Array 6.0, and BeadArray Technologies, for example, Illumina GoldenGate and Infinium assays, as can other platforms such as NimbleGen HD2.1 or HD4.2, High-Definition Comparative Genomic Hybridization (CGH) arrays (Agilent Technologies), tiling array technology (Affymetrix), multiplex ligation-dependent probe amplification (MLPA), Invader assay, fluorescence in situ hybridization, and, in one preferred embodiment, Array Comparative Genomic Hybridization (aCGH) methods. As described herein, karyotype analysis can be a method to determine the content and structure of chromosomes in a sample. In some embodiments, karyotyping can be used, in lieu of aCGH, to detect translocations, which can be copy number neutral, and, therefore, not detectable by aCGH. Information about amplitude of particular probes, which can be representative of particular alleles, can provide quantitative dosage information for the particular allele, and by consequence, dosage information about the CNV in question, since the marker can be selected as a marker representative of the CNV and can be located within the CNV. In some embodiments, if the CNV is a deletion, the absence of particular marker allele is representative of the deletion. In some embodiments, if the CNV is a duplication or a higher order copy number variation, the signal intensity representative of the allele correlating with the CNV can represent the copy number. A summary of methodologies commonly used is provided in Perkel (Perkel J Nature Methods 5:447-453 (2008)).

PCR assays can be utilized to detect CNVs and can provide an alternative to array analysis. In particular, PCR assays can enable detection of precise boundaries of gene/chromosome variants, at the molecular level, and which boundaries are identical in different individuals. PCR assays can be based on the amplification of a junction fragment present only in individuals that carry a deletion. This assay can convert the detection of a loss by array CGH to one of a gain by PCR.

Examples of PCR techniques that can be used in the present invention include, but are not limited to quantitative PCR, real-time quantitative PCR (qPCR), quantitative fluorescent PCR (QF-PCR), multiplex fluorescent PCR (MF-PCR), real time PCR (RT-PCR), single cell PCR, PCR- RFLP/RT-PCR-RFLP, hot start PCR and Nested PCR. Other suitable amplification methods include the ligase chain reaction (LCR), ligation mediated PCR (LM-PCR), degenerate oligonucleotide probe PCR (DOP-PCR), transcription amplification, self-sustained sequence replication, selective amplification of target polynucleotide sequences, consensus sequence primed polymerase chain reaction (CP-PCR), arbitrarily primed polymerase chain reaction (AP-PCR) and nucleic acid based sequence amplification (NABSA).

Alternative methods for the simultaneous interrogation of multiple regions include quantitative multiplex PCR of short fluorescent fragments (QMPSF), multiplex amplifiable probe hybridization (MAPH) and multiplex ligation-dependent probe amplification (MLPA), in which copy-number differences for up to 40 regions can be scored in one experiment. Another approach can be to specifically target regions that harbor known segmental duplications, which are often sites of copy-number variation. By targeting the variable nucleotides between two copies of a segmental duplication (called paralogous sequence variants) using a SNP-genotyping method that provides independent fluorescence intensities for the two alleles, it is possible to detect an increase in intensity of one allele compared with the other.

In another embodiment, the amplified piece of DNA can be bound to beads using the sequencing element of the nucleic acid tag under conditions that favor a single amplified piece of DNA molecule to bind a different bead and amplification occurs on each bead. In some embodiments, such amplification can occur by PCR. Each bead can be placed in a separate well, which can be a picoliter-sized well. In some embodiments, each bead is captured within a droplet of a PCR-reaction-mixture-in-oil-emulsion and PCR amplification occurs within each droplet. The amplification on the bead results in each bead carrying at least one million, at least 5 million, or at least 10 million copies of the single amplified piece of DNA molecule.

In embodiments where PCR occurs in oil-emulsion mixtures, the emulsion droplets are broken, the DNA is denatured and the beads carrying single-stranded nucleic acids clones are deposited into a well, such as a picoliter-sized well, for further analysis according to the methods described herein. These amplification methods allow for the analysis of genomic DNA regions. Methods for using bead amplification followed by fiber optics detection are described in Margulies et al. 2005, Nature. 15; 437(7057):376-80, and as well as in US Publication Application Nos. 20020012930; 20030068629; 20030100102; 20030148344; 20040248161; 20050079510, 20050124022; and 20060078909.

Another variation on the array-based approach can be to use the hybridization signal intensities that are obtained from the oligonucleotides employed on Affymetrix SNP arrays or in Illumina Bead Arrays. Here hybridization intensities are compared with average values that are derived from controls, such that deviations from these averages indicate a change in copy number. As well as providing information about copy number, SNP arrays have the added advantage of providing genotype information. For example, they can reveal loss of heterozygosity, which could provide supporting evidence for the presence of a deletion, or might indicate segmental uniparental disomy (which can recapitulate the effects of structural variation in some genomic regions—Prader-Willi and Angelman syndromes, for example).

Many of the basic procedures followed in microarray-based genome profiling are similar, if not identical, to those followed in expression profiling and SNP analysis, including the use of specialized microarray equipment and data-analysis tools. Since microarray-based expression profiling has been well established in the last decade, much can be learned from the technical advances made in this area. Examples of the use of microarrays in nucleic acid analysis that can be used are described in U.S. Pat. Nos. 6,300,063, 5,837,832, 6,969,589, 6,040,138, 6,858,412, U.S. application Ser. No. 08/529,115, U.S. application Ser. No. 10/272,384, U.S. application Ser. No. 10/045,575, U.S. application Ser. No. 10/264,571 and U.S. application Ser. No. 10/264,574. It should be noted that there are also distinct differences such as target and probe complexity, stability of DNA over RNA, the presence of repetitive DNA and the need to identify single copy number alterations in genome profiling.

In a preferred embodiment, the genetic variations detected comprise CNVs and can be detected using array CGH. In some embodiments, array CGH can be been implemented using a wide variety of techniques. The initial approaches used arrays produced from large-insert genomic clones such as bacterial artificial chromosomes (BACs). Producing sufficient BAC DNA of adequate purity to make arrays is arduous, so several techniques to amplify small amounts of starting material have been employed. These techniques include ligation-mediated PCR (Snijders et al, Nat. Genet. 29:263-64), degenerate primer PCR using one or several sets of primers, and rolling circle amplification. BAC arrays that provide complete genome tiling paths are also available. Arrays made from less complex nucleic acids such as cDNAs, selected PCR products, and oligonucleotides can also be used. Although most CGH procedures employ hybridization with total genomic DNA, it is possible to use reduced complexity representations of the genome produced by PCR techniques. Computational analysis of the genome sequence can be used to design array elements complementary to the sequences contained in the representation. Various SNP genotyping platforms, some of which use reduced complexity genomic representations, can be useful for their ability to determine both DNA copy number and allelic content across the genome. In some embodiments, small amounts of genomic DNA can be amplified with a variety of whole genome amplification methods prior to CGH analysis of the sample.

The different basic approaches to array CGH provide different levels of performance, so some are more suitable for particular applications than others. The factors that determine performance include the magnitudes of the copy number changes, their genomic extents, the state and composition of the specimen, how much material is available for analysis, and how the results of the analysis can be used. Many applications use reliable detection of copy number changes of much less than 50%, a more stringent requirement than for other microarray technologies. Note that technical details are extremely important and different implementations of methods using the same array CGH approach can yield different levels of performance. Various CGH methods are known in the art and are equally applicable to one or more methods of the present invention. For example, CGH methods are disclosed in U.S. Pat. Nos. 7,034,144; 7,030,231; 7,011,949; 7,014,997; 6,977,148; 6,951,761; and 6,916,621, the disclosure from each of which is incorporated by reference herein in its entirety.

The data provided by array CGH are quantitative measures of DNA sequence dosage. Array CGH provides high-resolution estimates of copy number aberrations, and can be performed efficiently on many samples. The advent of array CGH technology makes it possible to monitor DNA copy number changes on a genomic scale and many projects have been launched for studying the genome in specific diseases.

In a preferred embodiment, whole genome array-based comparative genome hybridization (array CGH) analysis, or array CGH on a subset of genomic regions, can be used to efficiently interrogate human genomes for genomic imbalances at multiple loci within a single assay. The development of comparative genomic hybridization (CGH) (Kallioniemi et al, 1992, Science 258: 818-21) provided the first efficient approach to scanning entire genomes for variations in DNA copy number. The importance of normal copy number variation involving large segments of DNA has been unappreciated. Array CGH is a breakthrough technique in human genetics, which is attracting interest from clinicians working in fields as diverse as cancer and IVF (In Vitro Fertilization). The use of CGH microarrays in the clinic holds great promise for identifying regions of genomic imbalance associated with disease. Advances from identifying chromosomal critical regions associated with specific phenotypes to identifying the specific dosage sensitive genes can lead to therapeutic opportunities of benefit to patients. Array CGH is a specific, sensitive and rapid technique that can enable the screening of the whole genome in a single test. It can facilitate and accelerate the screening process in human genetics and is expected to have a profound impact on the screening and counseling of patients with genetic disorders. It is now possible to identify the exact location on the chromosome where an aberration has occurred and it is possible to map these changes directly onto the genomic sequence.

An array CGH approach provides a robust method for carrying out a genome-wide scan to find novel copy number variants (CNVs). The array CGH methods can use labeled fragments from a genome of interest, which can be competitively hybridized with a second differentially labeled genome to arrays that are spotted with cloned DNA fragments, revealing copy-number differences between the two genomes. Genomic clones (for example, BACs), cDNAs, PCR products and oligonucleotides, can all be used as array targets. The use of array CGH with BACs was one of the earliest employed methods and is popular, owing to the extensive coverage of the genome it provides, the availability of reliable mapping data and ready access to clones. The last of these factors is important both for the array experiments themselves, and for confirmatory FISH experiments.

In a typical CGH measurement, total genomic DNA is isolated from control and reference subjects, differentially labeled, and hybridized to a representation of the genome that allows the binding of sequences at different genomic locations to be distinguished. More than two genomes can be compared simultaneously with suitable labels. Hybridization of highly repetitive sequences is typically suppressed by the inclusion of unlabeled Cot-1 DNA in the reaction. In some embodiments of array CGH, it is beneficial to mechanically shear the genomic DNA sample, for example, with sonication, prior to its labeling and hybridization step. In another embodiment, array CGH may be performed without use of Cot-1 DNA or a sonication step in the preparation of the genomic DNA sample. The relative hybridization intensity of the test and reference signals at a given location can be proportional to the relative copy number of those sequences in the test and reference genomes. If the reference genome is normal then increases and decreases in signal intensity ratios directly indicate DNA copy number variation within the genome of the test cells. Data are typically normalized so that the modal ratio for the genome is set to some standard value, typically 1.0 on a linear scale or 0.0 on a logarithmic scale. Additional measurements such as FISH or flow cytometry can be used to determine the actual copy number associated with a ratio level.

In some embodiments, an array CGH procedure can include the following steps. First, large-insert clones, for example, BACs can be obtained from a supplier of clone libraries. Then, small amounts of clone DNA can be amplified, for example, by degenerate oligonucleotide-primed (DOP) PCR or ligation-mediated PCR in order to obtain sufficient quantities needed for spotting. Next, PCR products can be spotted onto glass slides using, for example, microarray robots equipped with high-precision printing pins. Depending on the number of clones to be spotted and the space available on the microarray slide, clones can either be spotted once per array or in replicate. Repeated spotting of the same clone on an array can increase precision of the measurements if the spot intensities are averaged, and allows for a detailed statistical analysis of the quality of the experiments. Subject and control DNAs can be labeled, for example, with either Cy3 or Cy5-dUTP using random priming and can be subsequently hybridized onto the microarray in a solution containing an excess of Cot1-DNA to block repetitive sequences. Hybridizations can either be performed manually under a coverslip, in a gasket with gentle rocking or, automatically using commercially available hybridization stations. These automated hybridization stations can allow for an active hybridization process, thereby improving the reproducibility as well as reducing the actual hybridization time, which increases throughput. The hybridized DNAs can detected through the two different fluorochromes using standard microarray scanning equipment with either a scanning confocal laser or a charge coupled device (CCD) camera-based reader, followed by spot identification using commercially or freely available software packages.

The use of CGH with arrays that comprise long oligonucleotides (60-100 bp) can improve the detection resolution (in some embodiments, as small as ~3-5 kb sized CNVs on arrays designed for interrogation of human whole genomes) over that achieved using BACs (limited to 50-100 kb or larger sized CNVs due to the large size of BAC clones). In some embodiments, the resolution of oligonucleotide CGH arrays is achieved via in situ synthesis of 1-2 million unique features/probes per microarray, which can include microarrays available from Roche NimbleGen and Agilent Technologies. In addition to array CGH methods for copy number detection, other embodiments for partial or whole genome analysis of CNVs within a genome include, but are not limited to, use of SNP genotyping microarrays and sequencing methods.

Another method for copy number detection that uses oligonucleotides can be representational oligonucleotide microarray analysis (ROMA). It is similar to that applied in the use of BAC and CGH arrays, but to increase the signal-to-noise ratio, the 'complexity' of the input DNA is reduced by a method called representation or whole-genome sampling. Here, the DNA that is to be hybridized to the array can be treated by restriction digestion and then ligated to adapters, which results in the PCR-based amplification of fragments in a specific size-range. As a result, the amplified DNA can make up a fraction of the entire genomic sequence—that is, it is a representation of the input DNA that has significantly reduced complexity, which can lead to a reduction in background noise. Other suitable methods available to the skilled person can also be used, and are within scope of the present disclosure.

A comparison of one or more genomes relative to one or more other genomes with array CGH, or a variety of other CNV detection methods, can reveal the set of CNVs between two genomes, between one genome in comparison to multiple genomes, or between one set of genomes in comparison to another set of genomes. In some embodiments, an array CGH experiment can be performed by hybridizing a single test genome against a pooled sample of two or more genomes, which can result in minimizing the detection of higher frequency variants in the experiment. In some embodiments, a test genome can be hybridized alone (i.e., one-color detection) to a microarray, for example, using array CGH or SNP genotyping methods, and the comparison step to one or more reference genomes can be performed in silico to reveal the set of CNVs in the test genome relative to the one or more reference genomes. In one preferred embodiment, a single test genome is compared to a single reference genome in a 2-color experiment wherein both genomes are cohybridized to the microarray.

Array CGH can be used to identify genes that are causative or associated with a particular phenotype, condition, or disease by comparing the set of CNVs found in the affected cohort to the set of CNVs found in an unaffected cohort. An unaffected cohort may consist of any individual unaffected by the phenotype, condition, or disease of interest, but in one preferred embodiment is comprised of individuals or subjects that are apparently healthy (normal). Methods employed for such analyses are described in U.S. Pat. Nos. 7,702,468 and 7,957,913. In some embodiments of CNV comparison methods, candidate genes that are causative or associated (i.e., potentially serving as a biomarker) with a phenotype, condition, or disease will be identified by CNVs that occur in the affected cohort but not in the unaffected cohort. In some embodiments of CNV comparison methods, candidate genes that are causative or associated (i.e., potentially serving as a biomarker) with a phenotype, condition, or disease will be identified by CNVs that occur at a statistically significant higher frequency in the affected cohort as compared their frequency in the unaffected cohort. Thus, CNVs preferentially detected in the affected cohort as compared to the unaffected cohort can serve as beacons of genes that are causative or associated with a particular phenotype, condition, or disease. In some embodiments, CNV detection and comparison methods can result in direct identification of the gene that is causative or associated with phenotype, condition, or disease if the CNVs are found to overlap with or encompass the gene(s). In some embodiments, CNV detection and comparison methods can result in identification of regulatory regions of the genome (e.g., promoters, enhancers, transcription factor binding sites) that regulate the expression of one or more genes that are causative or associated with the phenotype, condition, or disease of interest.

Due to the large amount of genetic variation between any two genomes, or two sets (cohorts) of genomes, being compared, one preferred embodiment is to reduce the genetic variation search space by interrogating only CNVs, as opposed to the full set of genetic variants that can be identified in an individual's genome or exome. The set of CNVs that occur only, or at a statistically higher frequency, in the affected cohort as compared to the unaffected cohort can then be further investigated in targeted sequencing experiments to reveal the full set of genetic variants (of any size or type) that are causative or associated (i.e., potentially serving as a biomarker) with a phenotype, condition, or disease. It can be appreciated to those skilled in the art that the targeted sequencing experiments are performed in both the affected and unaffected cohorts in order to identify the genetic variants (e.g., SNVs and indels) that occur only, or at a statistically significant higher frequency, in the affected individual or cohort as compared to the unaffected cohort.

When investigating a particular phenotype, condition, or disease, such as ASD, it can be appreciated by those skilled in the art that the number of ASD candidate genes (or regulatory sequences) identified via CNV (or other variant types) detection methods may increase or decrease when additional ASD cohorts are analyzed. Similarly, the number of ASD candidate genes (or regulatory sequences), for example, identified via CNV (or other variant types) detection methods may increase or decrease when additional unaffected cohorts are used to interpret the affected cohort CNVs (or other variant types). For very rare CNVs (e.g., <0.1% frequency in the general population), only a single case may be observed in a given ASD cohort (e.g., 100 cases) but further statistical significance or evidence for the gene (or regulatory sequence/locus in the genome) can be established by: 1) CNV analysis of additional ASD cohorts, 2) CNV analysis of additional Normal cohorts, 3) targeted gene sequencing of both ASD and Normal cohorts, and/or 4) functional characterization of the ASD candidate gene (e.g., in silico analysis of the predicted impact of the candidate mutation on the gene product, RNAi knockdown experiments, biochemical assays on ASD patient tissue, gene expression analysis of disease-relevant tissues or of induced pluripotent stem cells (iPSCs) created from the ASD patient(s) harboring the candidate ASD-causing genetic variant).

It can be appreciated by those skilled in the art that a candidate gene may validate as causative of the phenotype, condition, or disease (e.g., ASD), which may, for example, be confirmed via mechanism of action experiments, or it may serve as a biomarker of the phenotype, condition, or disease. Thus, in the example of ASD, in some embodiments, the ASD-specific gene (or regulatory sequence/locus) may be a biomarker of age-of-onset for ASD and disease severity, and thus have diagnostic utility for monitoring patients known to be at risk for ASD or as a general screening test in the population for early diagnosis of the disease. In some embodiments, the ASD-specific gene/biomarker may be an indicator of drug response (e.g., a particular subtype of ASD may respond best to a therapeutic targeting a particular phenotype, causative gene, or other gene in the same pathway as the causative gene) and thus have utility during drug development in clinical trials. For example, clinical trials for a therapeutic that targets a ASD genetic subtype comprising only 10% of all patients exhibiting symptoms of ASD, can be designed to comprise only those 10% of patients with a specific genotype(s) in order to reduce the time and cost of such clinical trials (e.g., smaller number of patients in the clinical trial). It can be appreciated by those skilled in the art that such patient stratification methods (i.e., specific genotypes correlated with the disease or drug response) can be employed not only for targeted therapeutics, but in general for any drug that is approved or in development (i.e., the mechanism of action may or may not be known). For example, drugs in development or approved to treat, for example, cancer, may have utility in being repurposed to treat ASD. Such patient stratification methods can also be utilized to develop a companion diagnostic test (e.g., comprising the specific genes/genotypes found in patients that are indicative of drug response) for a particular drug, either concurrently during the clinical trials for the drug or after drug approval (e.g., as a new indication or for the physician to use in guiding medical decisions for the patient).

Further neurodevelopmental and/or links to ASD pathology can be established via pathway analysis of the genes, which may take into consideration binding interactions (e.g., via yeast 2-hybrid screen) and molecular events (e.g., kinase activity or other enzymatic processes) if such information is available for the gene(s) of interest (i.e., specified in the analysis). Both commercial (e.g., Ingenuity's IPA software and Thomson Reuter's GeneGo software) and open source software (e.g., String: string-db.org/) are available for such analyses. To assess connections to established ASD biology, analyses can be performed for the set of candidate ASD genes independently or against known causative ASD genes singly or as a group. In some embodiments, ASD candidate genes can be distributed into 5 main categories: 1) genes with neuroprotective function, 2) neuropsychiatric genes, some of which are known drug targets 3) genes linked to a known causative ASD gene (e.g., binding partner) or a novel gene family member of a known ASD gene, 4) genes linked to neurodevelopmental regulation, neurogenesis, and G-protein signaling pathways, and 5) other (e.g., established role in other diseases with no obvious neurodevelopmental biology, such as cancer) or unknown gene function (e.g., limited or no gene information presently annotated for the ASD-specific gene).

A method of screening a subject for a disease or disorder can comprise assaying a nucleic acid sample from the subject to detect sequence information for more than one genetic locus and comparing the sequence information to a panel of nucleic acid biomarkers and screening the subject for the presence or absence of the disease or disorder if one or more of low frequency biomarkers in the panel are present in the sequence information.

The panel can comprise at least one nucleic acid biomarker for each of the more than one genetic loci. For example, the panel can comprise 2, 3, 4, 5, 6, 7, 8, 9, 10, 11, 12, 3, 14, 15, 15, 17, 18, 19, 20, 25, 30, 35, 40, 45, 50, 75, 100, 150, 200 or more nucleic acid biomarkers for each of the more than one genetic loci. The panel can comprise at least 25 low frequency biomarkers. For example, the panel can comprise at least 30, 35, 40, 45, 50, 55, 60, 65, 70, 75, 80, 85, 90, 95, 100, 135, 150, 175, 200, 250, 500, or 1000 or more low frequency biomarkers. In some embodiments, the panel can comprise from about 2-1000 nucleic acid biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 nucleic acid biomarkers.

The panel can comprise at least 2 low frequency biomarkers. For example, the panel can comprise at least 2, 3, 4, 5, 6, 7, 8, 9, 10, 11, 12, 3, 14, 15, 15, 17, 18, 19, 20, 25, 30, 35, 40, 45, 50, 75, 100, 150, 200, 250, 500, or 1000 or more low frequency biomarkers. In some embodiments, the panel can comprise from about 2-1000 low frequency biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 1000 low frequency biomarkers. In some embodiments, a low frequency biomarker can occur at a frequency of 0.1% or less in a population of subjects without a diagnosis of the disease or disorder. For example, a low frequency biomarker can occur at a frequency of 0.05%, 0.01%, 0.005%, 0.001%, 0.0005%, 0.0001%, 0.00005%, or 0.00001% or less in a population of subjects without a diagnosis of the disease or disorder. In some embodiments, a low frequency biomarker can occur at a frequency from about 0.00001%-0.1% in a population of subjects without a diagnosis of the disease or disorder. For example, a low frequency biomarker can occur at a frequency of from about 0.00001%-0.00005%, 0.00001%-0.0001%, 0.00001%-0.0005%, 0.00001%-0.001%, 0.00001%-0.005%, 0.00001%-0.01%, 0.00001%-0.05%, 0.00005%-0.0001%, 0.00005%-0.0005%, 0.00005%-0.001%, 0.00005%-0.005%, 0.00005%-0.01%, 0.00005%-0.05%, 0.00005%-0.1%, 0.0001%-0.0005%, 0.0001%-0.001%, 0.0001%-0.005%, 0.0001%-0.01%, 0.0001%-0.05%, 0.0001%-0.1%, 0.0005%-0.001%, 0.0005%-0.005%, 0.0005%-0.01%, 0.0005%-0.05%, 0.0005%-0.1%, 0.001%-0.005%, 0.001%-0.01%, 0.001%-0.05%, 0.001%-0.1%, 0.005%-0.01%, 0.005%-0.05%, 0.005%-0.1%, 0.01%-0.05%, 0.01%-0.1%, or 0.05%-0.1% in a population of subjects without a diagnosis of the disease or disorder In some embodiments, the presence or absence of the disease or disorder in the subject can be determined with at least 50% confidence. For example, the presence or absence of the disease or disorder in the subject can be determined with at least 50%, 55%, 60%, 65%, 70%, 75%, 80%, 85%, 90%, 95%, 98%, 99%, or 100% confidence. In some embodiments, the presence or absence of the disease or disorder in the subject can be determined with a 50%-100% confidence. For example, the presence or absence of the disease or disorder in the subject can be determined with a 60%-100%, 70%-100%, 80%-100%, 90%-100%, 50%-90%, 50%-80%, 50%-70%, 50%-60%, 60%-90%, 60%-80%, 60%-70%, 70%-90%, 70%-80%, or 80%-90%. In one embodiment, ASD candidate CNV-subregions and genes associated with these regions can be determined or identified by comparing genetic data from a cohort of normal individuals (NVE) to that of a cohort of individuals known to have, or be susceptible to a developmental disorder such as ASD.

In some embodiments, genomic DNA samples from individuals within an NVE (reference) and an ASD (test) can be hybridized against one or more sex-matched reference individuals. For example, reference DNA samples can be labeled with a fluorophore such as Cy5, using methods described herein, and test subject DNA samples can be labeled with a different fluorophore, such as Cy3. After labeling, samples can be combined and can be co-hybridized to a microarray and analyzed using any of the methods described herein, such as aCGH.

Arrays can then be scanned and the data can be analyzed with software. Genetic alterations, such as CNVs, can be called using any of the methods described herein. A list of the genetic alterations, such as CNVs, can be generated for each cohort. The list of CNVs can be used to generate a master list of non-redundant CNVs and/or CNV-subregions for each cohort. The list can be based on the presence or absence of the CNV-subregion in individuals within the cohort. In this manner, the master list can contain a number of distinct CNV-subregions, some of which are uniquely present in a single individual and some of which are present in multiple individuals.

In some embodiments, CNV-subregions of interest can be obtained by annotation of each CNV-subregion with relevant information, such as overlap with known genes and/or exons. In some embodiments, CNV-subregions of interest can be obtained by calculating the OR for a CNV-subregion according to the following formula: OR=(ASD/((# individuals in ASD cohort)−ASD))/(NVE/((# individuals in NVE cohort)−NVE)), where: ASD=number of ASD individuals with a CNV-subregion of interest and NVE=number of NVE individuals with the CNV-subregion of interest. If NVE=0, it can be set to 1 to avoid dealing with infinities in cases where no CNVs are seen in the NVE. In some embodiments, a set of publicly available CNVs (e.g., the Database of Genomic Variants, http://projects.tcag.ca/variation/) can be used as the Normal cohort for comparison to the affected cohort CNVs. In another embodiment, the set of Normal cohort CNVs may comprise a private database generated by the same CNV detection method, such as array CGH, or by a plurality of CNV detection methods that include, but are not limited to, array CGH, SNP genotyping arrays, custom CGH arrays, custom genotyping arrays, exome sequencing, whole genome sequencing, targeted sequencing, FISH, q-PCR, or MLPA.

The number of individuals in any given cohort can be at least about 10, 50, 100, 200, 300, 400, 500, 600, 700, 800, 900, 1000, 2500, 5000, 7500, 10,000, 100,000, or more. In some embodiments, the number of individuals in any given cohort can be from 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000.

Different categories for CNVs of interest can be defined. In some embodiments, CNVs can be of interest if the CNVs are rare in the general population or in a cohort of individuals without the disease or condition of interest. In another embodiment, CNVs can be of interest if they are found only in those affected by a disease or condition and not in those without the disease or condition. In another embodiment, CNVs can be of interest if they are found at much greater frequency in those affected by the disease or condition as compared to those without the disease or condition.

Different categories for CNVs of interest can be defined. In some embodiments, CNVs/CNV-subregions can be of interest if the CNVs/CNV-subregions occur in the offspring of two parents, neither of whom has the relevant CNV. In some embodiments, CNVs/CNV-subregions can be of interest if the CNVs/CNV-subregions affect exons only, introns only, or exons and/or introns. In some embodiments, CNVs/CNV-subregions can be of interest if the CNVs/CNV-subregions are overlapping and/or non-overlapping within the same gene or regulatory locus. In some embodiments, CNVs/CNV-subregions can be of interest if the CNVs/CNV-subregions include regions present at high frequency in the ASD cohort compared to the normal cohort. In some embodiments, CNVs/CNV-subregions can be of interest if the CNVs/CNV-subregions occur in 2 or more ASD individuals affecting different exons of the same gene. In some embodiments, CNVs/CNV-subregions can be of interest if the CNVs/CNV-subregions occur in 2 or more ASD individuals affecting the same exon of a gene. In some embodiments, CNVs/CNV-subregions can be of interest if the CNVs/CNV-subregions have a relationship to genes with strong biological evidence in ASD. In some embodiments, CNVs can be of interest if the CNVs are associated with an OR greater than 0.5, 1, 2, 3, 4, 5, 6, 7, 8, 9, 10, 12, 14, 16, 18, 20, 25, 30, 35, 40, 45, 50, or more. In some embodiments, CNVs can be of interest if the CNVs are associated with an OR from about 2.8-100, 2.8-50, 2.8-40, 2.8-30, 2.8-20, 2.8-10, 2.8-9, 2.8-8, 2.8-7, 5-100, 5-50, 5-40, 5-30, 5-20, 5-10, 10-100, 10-50, 10-40, 10-30, 10-20, 20-100, 20-50, 20-40, 20-30, 30-100, 30-50, 30-40, 40-100, 40-50, or 50-100.

The data presented herein was generated on the basis of a comparison of CNVs/CNV-subregions identified in an ASD cohort. CNV/CNV-subregion genome locations are provided using the Human March 2006 (NCBI36/hg18) assembly. It can be appreciated by those skilled in the art that a CNV/CNV-subregion found in an affected individual may have one or more CNVs/CNV-subregions that are preferentially found in the affected cohort as compared to the unaffected cohort and, similarly, other CNVs/CNV-subregions that are found at comparable frequencies, or not statistically significant different frequencies, in the affected and unaffected cohorts. In a preferred embodiment, CNV/CNV-subregion detection and analysis methods are employed that enable comparison of CNVs/CNV-subregions to facilitate identification of genes (or regulatory loci) that are causative or associated with the phenotype, condition, or disease being investigated (or detected for diagnostic purposes). In Tables 1 and 5, SEQ IDs 1-643 and 2418-2557 refer to the CNV sequences (full sequence obtained for the whole CNV). In Tables 4 and 7, SEQ IDs 644-2417 and 2558-2739 refer to the genomic sequences over which the relevant transcripts extend (full genomic extent of the transcripts, not just the short sequence associated with the mRNA).

TABLE 1

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 1 | 17 | 77787243 | 77847938 | 60695 | Loss | 1891 | SLC16A3, CSNK1D | De Novo | NA |
| SEQ ID 2 | 17 | 76954271 | 77777066 | 822795 | Gain | 1891 | C17orf70, ACTG1, TSPAN10, DCXR, C17orf90, STRA13, ARL16, MIR3186, NPLOC4, PYCR1, SLC25A10, GPS1, DUS1L, ANAPC11, LOC92659, FASN, ARHGDIA, MAFG, BAHCC1, DYSFIP1, MRPL12, SIRT7, RAC3, CCDC57, P4HB, | De Novo | NA |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| | | | | | | | PCYT2, HGS, RFNG, MYADML2, FSCN2, THOC4, ASPSCR1, CCDC137, NOTUM, NPB, PDE6G, LRRC45 | | |
| SEQ ID 3 | 5 | 180189516 | 180362342 | 172826 | loss | 1229 | BTNL8, BTNL3, LOC729678, ZFP62 | Exon+ve, ≥2 cases | 59.24223602 |
| SEQ ID 3 | 5 | 180189516 | 180362342 | 172826 | loss | 1548 | BTNL8, BTNL3, LOC729678, ZFP62 | Exon+ve, ≥2 cases | 59.24223602 |
| SEQ ID 4 | 5 | 180189516 | 180365977 | 176461 | loss | 1532 | BTNL8, BTNL3, LOC729678, ZFP62 | Exon+ve, ≥2 cases | 59.24223602 |
| SEQ ID 5 | 5 | 180346557 | 180365977 | 19420 | Loss | 1540 | BTNL3 | Ctrl pos High OR | 59.24223602 |
| SEQ ID 5 | 5 | 180346557 | 180365977 | 19420 | Loss | 1754 | BTNL3 | Ctrl pos High OR | 59.24223602 |
| SEQ ID 5 | 5 | 180346557 | 180365977 | 19420 | Loss | 1755 | BTNL3 | Ctrl pos High OR | 59.24223602 |
| SEQ ID 6 | 5 | 180344964 | 180365977 | 21013 | Loss | 1261 | BTNL3 | Ctrl pos High OR | 59.24223602 |
| SEQ ID 6 | 5 | 180344964 | 180365977 | 21013 | Loss | 1265 | BTNL3 | Ctrl pos High OR | 59.24223602 |
| SEQ ID 6 | 5 | 180344964 | 180365977 | 21013 | Loss | 1438 | BTNL3 | Ctrl pos High OR | 59.24223602 |
| SEQ ID 6 | 5 | 180344964 | 180365977 | 21013 | Loss | 1467 | BTNL3 | Ctrl pos High OR | 59.24223602 |
| SEQ ID 6 | 5 | 180344964 | 180365977 | 21013 | Loss | 1568 | BTNL3 | Ctrl pos High OR | 59.24223602 |
| SEQ ID 6 | 5 | 180344964 | 180365977 | 21013 | Loss | 1570 | BTNL3 | Ctrl pos High OR | 59.24223602 |
| SEQ ID 6 | 5 | 180344964 | 180365977 | 21013 | Loss | 1662 | BTNL3 | Ctrl pos High OR | 59.24223602 |
| SEQ ID 6 | 5 | 180344964 | 180365977 | 21013 | Loss | 1671 | BTNL3 | Ctrl pos High OR | 59.24223602 |
| SEQ ID 6 | 5 | 180344964 | 180365977 | 21013 | Loss | 1726 | BTNL3 | Ctrl pos High OR | 59.24223602 |
| SEQ ID 6 | 5 | 180344964 | 180365977 | 21013 | Loss | 1769 | BTNL3 | Ctrl pos High OR | 59.24223602 |
| SEQ ID 6 | 5 | 180344964 | 180365977 | 21013 | Loss | 1799 | BTNL3 | Ctrl pos High OR | 59.24223602 |
| SEQ ID 7 | 5 | 180346557 | 180378586 | 32029 | Loss | 1942 | BTNL3 | Ctrl pos High OR | 59.24223602 |
| SEQ ID 8 | 5 | 180344964 | 180378586 | 33622 | Loss | 1268 | BTNL3 | Ctrl pos High OR | 59.24223602 |
| SEQ ID 8 | 5 | 180344964 | 180378586 | 33622 | Loss | 1354 | BTNL3 | Ctrl pos High OR | 59.24223602 |
| SEQ ID 8 | 5 | 180344964 | 180378586 | 33622 | Loss | 1463 | BTNL3 | Ctrl pos High OR | 59.24223602 |
| SEQ ID 8 | 5 | 180344964 | 180378586 | 33622 | Loss | 1849 | BTNL3 | Ctrl pos High OR | 59.24223602 |
| SEQ ID 9 | 5 | 180344964 | 180379663 | 34699 | Loss | 1277 | BTNL3 | Ctrl pos High OR | 59.24223602 |
| SEQ ID 10 | 5 | 180189516 | 180357210 | 167694 | loss | 1861 | BTNL8, BTNL3, LOC729678, ZFP62 | Exon+ve, ≥2 cases | 59.24223602 |
| SEQ ID 11 | 5 | 180192214 | 180362342 | 170128 | gain | 1316 | BTNL8, BTNL3, LOC729678, ZFP62 | Exon+ve, ≥2 cases | 59.24223602 |
| SEQ ID 11 | 5 | 180192214 | 180362342 | 170128 | loss | 1580 | BTNL8, BTNL3, LOC729678, ZFP62 | Exon+ve, ≥2 cases | 59.24223602 |
| SEQ ID 11 | 5 | 180192214 | 180362342 | 170128 | loss | 1641 | BTNL8, BTNL3, LOC729678, ZFP62 | Exon+ve, ≥2 cases | 59.24223602 |
| SEQ ID 12 | 5 | 180194323 | 180365977 | 171654 | Loss | 1546 | BTNL8, BTNL3, LOC729678, ZFP62 | Ctrl pos High OR | 59.24223602 |
| SEQ ID 12 | 5 | 180194323 | 180365977 | 171654 | Loss | 1696 | BTNL8, BTNL3, LOC729678, ZFP62 | Ctrl pos High OR | 59.24223602 |
| SEQ ID 12 | 5 | 180194323 | 180365977 | 171654 | Loss | 1792 | BTNL8, BTNL3, LOC729678, ZFP62 | Ctrl pos High OR | 59.24223602 |
| SEQ ID 12 | 5 | 180194323 | 180365977 | 171654 | Loss | 1927 | BTNL8, BTNL3, LOC729678, ZFP62 | Ctrl pos High OR | 59.24223602 |
| SEQ ID 13 | 5 | 180192214 | 180365977 | 173763 | loss | 1606 | BTNL8, BTNL3, LOC729678, ZFP62 | Exon+ve, ≥2 cases | 59.24223602 |
| SEQ ID 4 | 5 | 180189516 | 180365977 | 176461 | loss | 1612 | BTNL8, BTNL3, LOC729678, ZFP62 | Exon+ve, ≥2 cases | 59.24223602 |
| SEQ ID 4 | 5 | 180189516 | 180365977 | 176461 | loss | 1686 | BTNL8, BTNL3, LOC729678, ZFP62 | Exon+ve, ≥2 cases | 59.24223602 |
| SEQ ID 14 | 5 | 180194323 | 180378586 | 184263 | Loss | 1429 | BTNL8, BTNL3, LOC729678, ZFP62 | Ctrl pos High OR | 59.24223602 |
| SEQ ID 14 | 5 | 180194323 | 180378586 | 184263 | Loss | 1634 | BTNL8, BTNL3, LOC729678, ZFP62 | Ctrl pos High OR | 59.24223602 |
| SEQ ID 14 | 5 | 180194323 | 180378586 | 184263 | Loss | 1851 | BTNL8, BTNL3, LOC729678, ZFP62 | Ctrl pos High OR | 59.24223602 |
| SEQ ID 14 | 5 | 180194323 | 180378586 | 184263 | Loss | 1902 | BTNL8, BTNL3, LOC729678, ZFP62 | Ctrl pos High OR | 59.24223602 |
| SEQ ID 15 | 7 | 147704200 | 147708382 | 4182 | Loss | 1371 | CNTNAP2 | Ctrl pos High OR | 46.19631902 |
| SEQ ID 15 | 7 | 147704200 | 147708382 | 4182 | Loss | 1617 | CNTNAP2 | Ctrl pos High OR | 46.19631902 |
| SEQ ID 15 | 7 | 147704200 | 147708382 | 4182 | Loss | 1803 | CNTNAP2 | Ctrl pos High OR | 46.19631902 |
| SEQ ID 16 | 7 | 147704200 | 147710037 | 5837 | Loss | 1227 | CNTNAP2 | Ctrl pos High OR | 46.19631902 |
| SEQ ID 16 | 7 | 147704200 | 147710037 | 5837 | Loss | 1346 | CNTNAP2 | Ctrl pos High OR | 46.19631902 |
| SEQ ID 16 | 7 | 147704200 | 147710037 | 5837 | Loss | 1517 | CNTNAP2 | Ctrl pos High OR | 46.19631902 |
| SEQ ID 16 | 7 | 147704200 | 147710037 | 5837 | Loss | 1621 | CNTNAP2 | Ctrl pos High OR | 46.19631902 |
| SEQ ID 16 | 7 | 147704200 | 147710037 | 5837 | Loss | 1636 | CNTNAP2 | Ctrl pos High OR | 46.19631902 |
| SEQ ID 16 | 7 | 147704200 | 147710037 | 5837 | Loss | 1639 | CNTNAP2 | Ctrl pos High OR | 46.19631902 |
| SEQ ID 16 | 7 | 147704200 | 147710037 | 5837 | Loss | 1645 | CNTNAP2 | Ctrl pos High OR | 46.19631902 |
| SEQ ID 16 | 7 | 147704200 | 147710037 | 5837 | Loss | 1670 | CNTNAP2 | Ctrl pos High OR | 46.19631902 |
| SEQ ID 16 | 7 | 147704200 | 147710037 | 5837 | Loss | 1727 | CNTNAP2 | Ctrl pos High OR | 46.19631902 |
| SEQ ID 16 | 7 | 147704200 | 147710037 | 5837 | Loss | 1753 | CNTNAP2 | Ctrl pos High OR | 46.19631902 |
| SEQ ID 16 | 7 | 147704200 | 147710037 | 5837 | Loss | 1754 | CNTNAP2 | Ctrl pos High OR | 46.19631902 |
| SEQ ID 16 | 7 | 147704200 | 147710037 | 5837 | Loss | 1761 | CNTNAP2 | Ctrl pos High OR | 46.19631902 |
| SEQ ID 16 | 7 | 147704200 | 147710037 | 5837 | Loss | 1792 | CNTNAP2 | Ctrl pos High OR | 46.19631902 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 16 | 7 | 147704200 | 147710037 | 5837 | Loss | 1806 | CNTNAP2 | Ctrl pos High OR | 46.19631902 |
| SEQ ID 16 | 7 | 147704200 | 147710037 | 5837 | Loss | 1820 | CNTNAP2 | Ctrl pos High OR | 46.19631902 |
| SEQ ID 16 | 7 | 147704200 | 147710037 | 5837 | Loss | 1826 | CNTNAP2 | Ctrl pos High OR | 46.19631902 |
| SEQ ID 16 | 7 | 147704200 | 147710037 | 5837 | Loss | 1836 | CNTNAP2 | Ctrl pos High OR | 46.19631902 |
| SEQ ID 16 | 7 | 147704200 | 147710037 | 5837 | Loss | 1854 | CNTNAP2 | Ctrl pos High OR | 46.19631902 |
| SEQ ID 16 | 7 | 147704200 | 147710037 | 5837 | Loss | 1867 | CNTNAP2 | Ctrl pos High OR | 46.19631902 |
| SEQ ID 16 | 7 | 147704200 | 147710037 | 5837 | Loss | 1872 | CNTNAP2 | Ctrl pos High OR | 46.19631902 |
| SEQ ID 16 | 7 | 147704200 | 147710037 | 5837 | Loss | 1916 | CNTNAP2 | Ctrl pos High OR | 46.19631902 |
| SEQ ID 16 | 7 | 147704200 | 147710037 | 5837 | Loss | 1918 | CNTNAP2 | Ctrl pos High OR | 46.19631902 |
| SEQ ID 16 | 7 | 147704200 | 147710037 | 5837 | Loss | 1960 | CNTNAP2 | Ctrl pos High OR | 46.19631902 |
| SEQ ID 16 | 7 | 147704200 | 147710037 | 5837 | Loss | 2003 | CNTNAP2 | Ctrl pos High OR | 46.19631902 |
| SEQ ID 16 | 7 | 147704200 | 147710037 | 5837 | Loss | 2028 | CNTNAP2 | Ctrl pos High OR | 46.19631902 |
| SEQ ID 16 | 7 | 147704200 | 147710037 | 5837 | Loss | 2041 | CNTNAP2 | Ctrl pos High OR | 46.19631902 |
| SEQ ID 17 | 7 | 147702365 | 147710037 | 7672 | Loss | 1728 | CNTNAP2 | Ctrl pos High OR | 46.19631902 |
| SEQ ID 18 | 15 | 99632987 | 99635701 | 2714 | gain | 1404 | SELS | Exon+ve, ≥2 cases | 41.38625954 |
| SEQ ID 19 | 15 | 99632987 | 99636724 | 3737 | gain | 1728 | SELS | Exon+ve, ≥2 cases | 41.38625954 |
| SEQ ID 20 | 15 | 99634434 | 99635701 | 1267 | loss | 1389 | SELS | Exon+ve, ≥2 cases | 41.38625954 |
| SEQ ID 20 | 15 | 99634434 | 99635701 | 1267 | gain | 1401 | SELS | Exon+ve, ≥2 cases | 41.38625954 |
| SEQ ID 20 | 15 | 99634434 | 99635701 | 1267 | loss | 1413 | SELS | Exon+ve, ≥2 cases | 41.38625954 |
| SEQ ID 20 | 15 | 99634434 | 99635701 | 1267 | loss | 1416 | SELS | Exon+ve, ≥2 cases | 41.38625954 |
| SEQ ID 20 | 15 | 99634434 | 99635701 | 1267 | gain | 1434 | SELS | Exon+ve, ≥2 cases | 41.38625954 |
| SEQ ID 20 | 15 | 99634434 | 99635701 | 1267 | loss | 1446 | SELS | Exon+ve, ≥2 cases | 41.38625954 |
| SEQ ID 20 | 15 | 99634434 | 99635701 | 1267 | loss | 1449 | SELS | Exon+ve, ≥2 cases | 41.38625954 |
| SEQ ID 20 | 15 | 99634434 | 99635701 | 1267 | loss | 1461 | SELS | Exon+ve, ≥2 cases | 41.38625954 |
| SEQ ID 20 | 15 | 99634434 | 99635701 | 1267 | loss | 1477 | SELS | Exon+ve, ≥2 cases | 41.38625954 |
| SEQ ID 20 | 15 | 99634434 | 99635701 | 1267 | loss | 1505 | SELS | Exon+ve, ≥2 cases | 41.38625954 |
| SEQ ID 20 | 15 | 99634434 | 99635701 | 1267 | loss | 1529 | SELS | Exon+ve, ≥2 cases | 41.38625954 |
| SEQ ID 20 | 15 | 99634434 | 99635701 | 1267 | loss | 1548 | SELS | Exon+ve, ≥2 cases | 41.38625954 |
| SEQ ID 20 | 15 | 99634434 | 99635701 | 1267 | loss | 1559 | SELS | Exon+ve, ≥2 cases | 41.38625954 |
| SEQ ID 20 | 15 | 99634434 | 99635701 | 1267 | loss | 1572 | SELS | Exon+ve, ≥2 cases | 41.38625954 |
| SEQ ID 20 | 15 | 99634434 | 99635701 | 1267 | gain | 1576 | SELS | Exon+ve, ≥2 cases | 41.38625954 |
| SEQ ID 20 | 15 | 99634434 | 99635701 | 1267 | loss | 1584 | SELS | Exon+ve, ≥2 cases | 41.38625954 |
| SEQ ID 20 | 15 | 99634434 | 99635701 | 1267 | gain | 1596 | SELS | Exon+ve, ≥2 cases | 41.38625954 |
| SEQ ID 20 | 15 | 99634434 | 99635701 | 1267 | loss | 1609 | SELS | Exon+ve, ≥2 cases | 41.38625954 |
| SEQ ID 20 | 15 | 99634434 | 99635701 | 1267 | gain | 1633 | SELS | Exon+ve, ≥2 cases | 41.38625954 |
| SEQ ID 20 | 15 | 99634434 | 99635701 | 1267 | loss | 1672 | SELS | Exon+ve, ≥2 cases | 41.38625954 |
| SEQ ID 20 | 15 | 99634434 | 99635701 | 1267 | loss | 1687 | SELS | Exon+ve, ≥2 cases | 41.38625954 |
| SEQ ID 20 | 15 | 99634434 | 99635701 | 1267 | loss | 1829 | SELS | Exon+ve, ≥2 cases | 41.38625954 |
| SEQ ID 20 | 15 | 99634434 | 99635701 | 1267 | gain | 1842 | SELS | Exon+ve, ≥2 cases | 41.38625954 |
| SEQ ID 20 | 15 | 99634434 | 99635701 | 1267 | loss | 1913 | SELS | Exon+ve, ≥2 cases | 41.38625954 |
| SEQ ID 20 | 15 | 99634434 | 99635701 | 1267 | loss | 1964 | SELS | Exon+ve, ≥2 cases | 41.38625954 |
| SEQ ID 21 | X | 43458232 | 43465307 | 7075 | Loss | 1800 | MAOA | Intronic | 38.20395738 |
| SEQ ID 21 | X | 43458232 | 43465307 | 7075 | Loss | 1842 | MAOA | Intronic | 38.20395738 |
| SEQ ID 21 | X | 43458232 | 43465307 | 7075 | Loss | 1848 | MAOA | Intronic | 38.20395738 |
| SEQ ID 21 | X | 43458232 | 43465307 | 7075 | Loss | 1855 | MAOA | Intronic | 38.20395738 |
| SEQ ID 21 | X | 43458232 | 43465307 | 7075 | Loss | 1859 | MAOA | Intronic | 38.20395738 |
| SEQ ID 21 | X | 43458232 | 43465307 | 7075 | Loss | 1898 | MAOA | Intronic | 38.20395738 |
| SEQ ID 21 | X | 43458232 | 43465307 | 7075 | Loss | 1907 | MAOA | Intronic | 38.20395738 |
| SEQ ID 21 | X | 43458232 | 43465307 | 7075 | Loss | 1916 | MAOA | Intronic | 38.20395738 |
| SEQ ID 21 | X | 43458232 | 43465307 | 7075 | Loss | 1921 | MAOA | Intronic | 38.20395738 |
| SEQ ID 21 | X | 43458232 | 43465307 | 7075 | Loss | 1935 | MAOA | Intronic | 38.20395738 |
| SEQ ID 21 | X | 43458232 | 43465307 | 7075 | Loss | 1946 | MAOA | Intronic | 38.20395738 |
| SEQ ID 21 | X | 43458232 | 43465307 | 7075 | Loss | 1958 | MAOA | Intronic | 38.20395738 |
| SEQ ID 21 | X | 43458232 | 43465307 | 7075 | Loss | 1960 | MAOA | Intronic | 38.20395738 |
| SEQ ID 21 | X | 43458232 | 43465307 | 7075 | Loss | 1961 | MAOA | Intronic | 38.20395738 |
| SEQ ID 21 | X | 43458232 | 43465307 | 7075 | Loss | 1965 | MAOA | Intronic | 38.20395738 |
| SEQ ID 21 | X | 43458232 | 43465307 | 7075 | Loss | 1966 | MAOA | Intronic | 38.20395738 |
| SEQ ID 21 | X | 43458232 | 43465307 | 7075 | Loss | 1967 | MAOA | Intronic | 38.20395738 |
| SEQ ID 21 | X | 43458232 | 43465307 | 7075 | Loss | 1969 | MAOA | Intronic | 38.20395738 |
| SEQ ID 21 | X | 43458232 | 43465307 | 7075 | Loss | 1993 | MAOA | Intronic | 38.20395738 |
| SEQ ID 21 | X | 43458232 | 43465307 | 7075 | Loss | 2033 | MAOA | Intronic | 38.20395738 |
| SEQ ID 21 | X | 43458232 | 43465307 | 7075 | Loss | 2035 | MAOA | Intronic | 38.20395738 |
| SEQ ID 22 | X | 43457175 | 43465307 | 8132 | Loss | 1369 | MAOA | Intronic | 38.20395738 |
| SEQ ID 21 | X | 43458232 | 43465307 | 7075 | Loss | 1300 | MAOA | Intronic | 38.20395738 |
| SEQ ID 21 | X | 43458232 | 43465307 | 7075 | Loss | 1697 | MAOA | Intronic | 38.20395738 |
| SEQ ID 21 | X | 43458232 | 43465307 | 7075 | Loss | 1751 | MAOA | Intronic | 38.20395738 |
| SEQ ID 23 | 17 | 41506317 | 41710400 | 204083 | loss | 1319 | LOC644246, KIAA1267 | Exon+ve, ≥2 cases | 31.89712557 |
| SEQ ID 24 | 17 | 41504832 | 41710400 | 205568 | loss | 1320 | LOC644246, KIAA1267 | Exon+ve, ≥2 cases | 31.89712557 |
| SEQ ID 25 | 17 | 41508943 | 42142363 | 633420 | loss | 1542 | NSFP1, NSF, ARL17B, LOC644246, LRRC37A2, ARL17A, LRRC37A, KIAA1267 | Exon+ve, ≥2 cases | 31.89712557 |
| SEQ ID 26 | 17 | 41508943 | 41566540 | 57597 | loss | 1656 | KIAA1267 | Exon+ve, ≥2 cases | 31.89712557 |
| SEQ ID 27 | 17 | 41508943 | 41579322 | 70379 | loss | 1861 | KIAA1267 | Exon+ve, ≥2 cases | 31.89712557 |
| SEQ ID 28 | 17 | 41514481 | 41710400 | 195919 | loss | 1655 | LOC644246, KIAA1267 | Exon+ve, ≥2 cases | 31.89712557 |
| SEQ ID 29 | 17 | 41512318 | 41710400 | 198082 | loss | 1530 | LOC644246, KIAA1267 | Exon+ve, ≥2 cases | 31.89712557 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 29 | 17 | 41512318 | 41710400 | 198082 | loss | 1533 | LOC644246, KIAA1267 | Exon+ve, ≥2 cases | 31.89712557 |
| SEQ ID 29 | 17 | 41512318 | 41710400 | 198082 | loss | 1535 | LOC644246, KIAA1267 | Exon+ve, ≥2 cases | 31.89712557 |
| SEQ ID 29 | 17 | 41512318 | 41710400 | 198082 | loss | 1537 | LOC644246, KIAA1267 | Exon+ve, ≥2 cases | 31.89712557 |
| SEQ ID 29 | 17 | 41512318 | 41710400 | 198082 | loss | 1539 | LOC644246, KIAA1267 | Exon+ve, ≥2 cases | 31.89712557 |
| SEQ ID 29 | 17 | 41512318 | 41710400 | 198082 | loss | 1586 | LOC644246, KIAA1267 | Exon+ve, ≥2 cases | 31.89712557 |
| SEQ ID 29 | 17 | 41512318 | 41710400 | 198082 | loss | 1684 | LOC644246, KIAA1267 | Exon+ve, ≥2 cases | 31.89712557 |
| SEQ ID 30 | 17 | 41508943 | 41710400 | 201457 | loss | 1587 | LOC644246, KIAA1267 | Exon+ve, ≥2 cases | 31.89712557 |
| SEQ ID 31 | 17 | 41706870 | 42147225 | 440355 | gain | 1991 | NSF, ARL17B, NSFP1, LRRC37A2, LRRC37A, ARL17A | Exon+ve, ≥2 cases | 31.89712557 |
| SEQ ID 32 | 17 | 41568539 | 42147225 | 578686 | gain | 2032 | NSFP1, NSF, ARL17B, LOC644246, LRRC37A2, ARL17A, LRRC37A, KIAA1267 | Exon+ve, ≥2 cases | 31.89712557 |
| SEQ ID 33 | 17 | 41568539 | 42151941 | 583402 | gain | 1800 | NSFP1, NSF, ARL17B, LOC644246, LRRC37A2, ARL17A, LRRC37A, KIAA1267 | Exon+ve, ≥2 cases | 31.89712557 |
| SEQ ID 34 | 17 | 41521544 | 42148637 | 627093 | gain | 1671 | NSFP1, NSF, ARL17B, LOC644246, LRRC37A2, ARL17A, LRRC37A, KIAA1267 | Exon+ve, ≥2 cases | 31.89712557 |
| SEQ ID 34 | 17 | 41521544 | 42148637 | 627093 | gain | 1751 | NSFP1, NSF, ARL17B, LOC644246, LRRC37A2, ARL17A, LRRC37A, KIAA1267 | Exon+ve, ≥2 cases | 31.89712557 |
| SEQ ID 35 | 17 | 41512318 | 42142363 | 630045 | loss | 1662 | NSFP1, NSF, ARL17B, LOC644246, LRRC37A2, ARL17A, LRRC37A, KIAA1267 | Exon+ve, ≥2 cases | 31.89712557 |
| SEQ ID 36 | 17 | 41512318 | 42151941 | 639623 | loss | 1536 | NSFP1, NSF, ARL17B, LOC644246, LRRC37A2, ARL17A, LRRC37A, KIAA1267 | Exon+ve, ≥2 cases | 31.89712557 |
| SEQ ID 37 | 7 | 147704200 | 147707161 | 2961 | Gain | 1808 | CNTNAP2 | Ctrl pos High OR | 30.75754113 |
| SEQ ID 37 | 7 | 147704200 | 147707161 | 2961 | Gain | 1877 | CNTNAP2 | Ctrl pos High OR | 30.75754113 |
| SEQ ID 37 | 7 | 147704200 | 147707161 | 2961 | Gain | 1895 | CNTNAP2 | Ctrl pos High OR | 30.75754113 |
| SEQ ID 37 | 7 | 147704200 | 147707161 | 2961 | Gain | 1907 | CNTNAP2 | Ctrl pos High OR | 30.75754113 |
| SEQ ID 37 | 7 | 147704200 | 147707161 | 2961 | Gain | 1951 | CNTNAP2 | Ctrl pos High OR | 30.75754113 |
| SEQ ID 37 | 7 | 147704200 | 147707161 | 2961 | Gain | 1994 | CNTNAP2 | Ctrl pos High OR | 30.75754113 |
| SEQ ID 37 | 7 | 147704200 | 147707161 | 2961 | Gain | 2006 | CNTNAP2 | Ctrl pos High OR | 30.75754113 |
| SEQ ID 15 | 7 | 147704200 | 147708382 | 4182 | Gain | 1220 | CNTNAP2 | Ctrl pos High OR | 30.75754113 |
| SEQ ID 15 | 7 | 147704200 | 147708382 | 4182 | Gain | 1223 | CNTNAP2 | Ctrl pos High OR | 30.75754113 |
| SEQ ID 15 | 7 | 147704200 | 147708382 | 4182 | Gain | 1230 | CNTNAP2 | Ctrl pos High OR | 30.75754113 |
| SEQ ID 15 | 7 | 147704200 | 147708382 | 4182 | Gain | 1234 | CNTNAP2 | Ctrl pos High OR | 30.75754113 |
| SEQ ID 15 | 7 | 147704200 | 147708382 | 4182 | Gain | 1240 | CNTNAP2 | Ctrl pos High OR | 30.75754113 |
| SEQ ID 15 | 7 | 147704200 | 147708382 | 4182 | Gain | 1252 | CNTNAP2 | Ctrl pos High OR | 30.75754113 |
| SEQ ID 15 | 7 | 147704200 | 147708382 | 4182 | Gain | 1281 | CNTNAP2 | Ctrl pos High OR | 30.75754113 |
| SEQ ID 15 | 7 | 147704200 | 147708382 | 4182 | Gain | 1282 | CNTNAP2 | Ctrl pos High OR | 30.75754113 |
| SEQ ID 15 | 7 | 147704200 | 147708382 | 4182 | Gain | 1284 | CNTNAP2 | Ctrl pos High OR | 30.75754113 |
| SEQ ID 15 | 7 | 147704200 | 147708382 | 4182 | Gain | 1286 | CNTNAP2 | Ctrl pos High OR | 30.75754113 |
| SEQ ID 15 | 7 | 147704200 | 147708382 | 4182 | Gain | 1290 | CNTNAP2 | Ctrl pos High OR | 30.75754113 |
| SEQ ID 15 | 7 | 147704200 | 147708382 | 4182 | Gain | 1307 | CNTNAP2 | Ctrl pos High OR | 30.75754113 |
| SEQ ID 15 | 7 | 147704200 | 147708382 | 4182 | Gain | 1308 | CNTNAP2 | Ctrl pos High OR | 30.75754113 |
| SEQ ID 15 | 7 | 147704200 | 147708382 | 4182 | Gain | 1309 | CNTNAP2 | Ctrl pos High OR | 30.75754113 |
| SEQ ID 15 | 7 | 147704200 | 147708382 | 4182 | Gain | 1318 | CNTNAP2 | Ctrl pos High OR | 30.75754113 |
| SEQ ID 15 | 7 | 147704200 | 147708382 | 4182 | Gain | 1320 | CNTNAP2 | Ctrl pos High OR | 30.75754113 |
| SEQ ID 15 | 7 | 147704200 | 147708382 | 4182 | Gain | 1345 | CNTNAP2 | Ctrl pos High OR | 30.75754113 |
| SEQ ID 15 | 7 | 147704200 | 147708382 | 4182 | Gain | 1389 | CNTNAP2 | Ctrl pos High OR | 30.75754113 |
| SEQ ID 15 | 7 | 147704200 | 147708382 | 4182 | Gain | 1405 | CNTNAP2 | Ctrl pos High OR | 30.75754113 |
| SEQ ID 15 | 7 | 147704200 | 147708382 | 4182 | Gain | 1415 | CNTNAP2 | Ctrl pos High OR | 30.75754113 |
| SEQ ID 15 | 7 | 147704200 | 147708382 | 4182 | Gain | 1421 | CNTNAP2 | Ctrl pos High OR | 30.75754113 |
| SEQ ID 15 | 7 | 147704200 | 147708382 | 4182 | Gain | 1422 | CNTNAP2 | Ctrl pos High OR | 30.75754113 |
| SEQ ID 15 | 7 | 147704200 | 147708382 | 4182 | Gain | 1425 | CNTNAP2 | Ctrl pos High OR | 30.75754113 |
| SEQ ID 15 | 7 | 147704200 | 147708382 | 4182 | Gain | 1432 | CNTNAP2 | Ctrl pos High OR | 30.75754113 |
| SEQ ID 15 | 7 | 147704200 | 147708382 | 4182 | Gain | 1434 | CNTNAP2 | Ctrl pos High OR | 30.75754113 |
| SEQ ID 15 | 7 | 147704200 | 147708382 | 4182 | Gain | 1438 | CNTNAP2 | Ctrl pos High OR | 30.75754113 |
| SEQ ID 15 | 7 | 147704200 | 147708382 | 4182 | Gain | 1440 | CNTNAP2 | Ctrl pos High OR | 30.75754113 |
| SEQ ID 15 | 7 | 147704200 | 147708382 | 4182 | Gain | 1442 | CNTNAP2 | Ctrl pos High OR | 30.75754113 |
| SEQ ID 15 | 7 | 147704200 | 147708382 | 4182 | Gain | 1463 | CNTNAP2 | Ctrl pos High OR | 30.75754113 |
| SEQ ID 15 | 7 | 147704200 | 147708382 | 4182 | Gain | 1466 | CNTNAP2 | Ctrl pos High OR | 30.75754113 |
| SEQ ID 15 | 7 | 147704200 | 147708382 | 4182 | Gain | 1472 | CNTNAP2 | Ctrl pos High OR | 30.75754113 |
| SEQ ID 15 | 7 | 147704200 | 147708382 | 4182 | Gain | 1473 | CNTNAP2 | Ctrl pos High OR | 30.75754113 |
| SEQ ID 15 | 7 | 147704200 | 147708382 | 4182 | Gain | 1490 | CNTNAP2 | Ctrl pos High OR | 30.75754113 |
| SEQ ID 15 | 7 | 147704200 | 147708382 | 4182 | Gain | 1492 | CNTNAP2 | Ctrl pos High OR | 30.75754113 |
| SEQ ID 15 | 7 | 147704200 | 147708382 | 4182 | Gain | 1495 | CNTNAP2 | Ctrl pos High OR | 30.75754113 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 15 | 7 | 147704200 | 147708382 | 4182 | Gain | 1496 | CNTNAP2 | Ctrl pos High OR | 30.75754113 |
| SEQ ID 15 | 7 | 147704200 | 147708382 | 4182 | Gain | 1497 | CNTNAP2 | Ctrl pos High OR | 30.75754113 |
| SEQ ID 15 | 7 | 147704200 | 147708382 | 4182 | Gain | 1498 | CNTNAP2 | Ctrl pos High OR | 30.75754113 |
| SEQ ID 15 | 7 | 147704200 | 147708382 | 4182 | Gain | 1502 | CNTNAP2 | Ctrl pos High OR | 30.75754113 |
| SEQ ID 15 | 7 | 147704200 | 147708382 | 4182 | Gain | 1504 | CNTNAP2 | Ctrl pos High OR | 30.75754113 |
| SEQ ID 15 | 7 | 147704200 | 147708382 | 4182 | Gain | 1506 | CNTNAP2 | Ctrl pos High OR | 30.75754113 |
| SEQ ID 15 | 7 | 147704200 | 147708382 | 4182 | Gain | 1508 | CNTNAP2 | Ctrl pos High OR | 30.75754113 |
| SEQ ID 15 | 7 | 147704200 | 147708382 | 4182 | Gain | 1512 | CNTNAP2 | Ctrl pos High OR | 30.75754113 |
| SEQ ID 15 | 7 | 147704200 | 147708382 | 4182 | Gain | 1513 | CNTNAP2 | Ctrl pos High OR | 30.75754113 |
| SEQ ID 15 | 7 | 147704200 | 147708382 | 4182 | Gain | 1514 | CNTNAP2 | Ctrl pos High OR | 30.75754113 |
| SEQ ID 15 | 7 | 147704200 | 147708382 | 4182 | Gain | 1515 | CNTNAP2 | Ctrl pos High OR | 30.75754113 |
| SEQ ID 15 | 7 | 147704200 | 147708382 | 4182 | Gain | 1519 | CNTNAP2 | Ctrl pos High OR | 30.75754113 |
| SEQ ID 15 | 7 | 147704200 | 147708382 | 4182 | Gain | 1520 | CNTNAP2 | Ctrl pos High OR | 30.75754113 |
| SEQ ID 15 | 7 | 147704200 | 147708382 | 4182 | Gain | 1528 | CNTNAP2 | Ctrl pos High OR | 30.75754113 |
| SEQ ID 15 | 7 | 147704200 | 147708382 | 4182 | Gain | 1534 | CNTNAP2 | Ctrl pos High OR | 30.75754113 |
| SEQ ID 15 | 7 | 147704200 | 147708382 | 4182 | Gain | 1543 | CNTNAP2 | Ctrl pos High OR | 30.75754113 |
| SEQ ID 15 | 7 | 147704200 | 147708382 | 4182 | Gain | 1544 | CNTNAP2 | Ctrl pos High OR | 30.75754113 |
| SEQ ID 15 | 7 | 147704200 | 147708382 | 4182 | Gain | 1556 | CNTNAP2 | Ctrl pos High OR | 30.75754113 |
| SEQ ID 15 | 7 | 147704200 | 147708382 | 4182 | Gain | 1557 | CNTNAP2 | Ctrl pos High OR | 30.75754113 |
| SEQ ID 15 | 7 | 147704200 | 147708382 | 4182 | Gain | 1558 | CNTNAP2 | Ctrl pos High OR | 30.75754113 |
| SEQ ID 15 | 7 | 147704200 | 147708382 | 4182 | Gain | 1559 | CNTNAP2 | Ctrl pos High OR | 30.75754113 |
| SEQ ID 15 | 7 | 147704200 | 147708382 | 4182 | Gain | 1560 | CNTNAP2 | Ctrl pos High OR | 30.75754113 |
| SEQ ID 15 | 7 | 147704200 | 147708382 | 4182 | Gain | 1565 | CNTNAP2 | Ctrl pos High OR | 30.75754113 |
| SEQ ID 15 | 7 | 147704200 | 147708382 | 4182 | Gain | 1570 | CNTNAP2 | Ctrl pos High OR | 30.75754113 |
| SEQ ID 15 | 7 | 147704200 | 147708382 | 4182 | Gain | 1571 | CNTNAP2 | Ctrl pos High OR | 30.75754113 |
| SEQ ID 15 | 7 | 147704200 | 147708382 | 4182 | Gain | 1573 | CNTNAP2 | Ctrl pos High OR | 30.75754113 |
| SEQ ID 15 | 7 | 147704200 | 147708382 | 4182 | Gain | 1584 | CNTNAP2 | Ctrl pos High OR | 30.75754113 |
| SEQ ID 15 | 7 | 147704200 | 147708382 | 4182 | Gain | 1586 | CNTNAP2 | Ctrl pos High OR | 30.75754113 |
| SEQ ID 15 | 7 | 147704200 | 147708382 | 4182 | Gain | 1592 | CNTNAP2 | Ctrl pos High OR | 30.75754113 |
| SEQ ID 15 | 7 | 147704200 | 147708382 | 4182 | Gain | 1597 | CNTNAP2 | Ctrl pos High OR | 30.75754113 |
| SEQ ID 15 | 7 | 147704200 | 147708382 | 4182 | Gain | 1601 | CNTNAP2 | Ctrl pos High OR | 30.75754113 |
| SEQ ID 15 | 7 | 147704200 | 147708382 | 4182 | Gain | 1602 | CNTNAP2 | Ctrl pos High OR | 30.75754113 |
| SEQ ID 15 | 7 | 147704200 | 147708382 | 4182 | Gain | 1603 | CNTNAP2 | Ctrl pos High OR | 30.75754113 |
| SEQ ID 15 | 7 | 147704200 | 147708382 | 4182 | Gain | 1610 | CNTNAP2 | Ctrl pos High OR | 30.75754113 |
| SEQ ID 15 | 7 | 147704200 | 147708382 | 4182 | Gain | 1618 | CNTNAP2 | Ctrl pos High OR | 30.75754113 |
| SEQ ID 15 | 7 | 147704200 | 147708382 | 4182 | Gain | 1619 | CNTNAP2 | Ctrl pos High OR | 30.75754113 |
| SEQ ID 15 | 7 | 147704200 | 147708382 | 4182 | Gain | 1620 | CNTNAP2 | Ctrl pos High OR | 30.75754113 |
| SEQ ID 15 | 7 | 147704200 | 147708382 | 4182 | Gain | 1622 | CNTNAP2 | Ctrl pos High OR | 30.75754113 |
| SEQ ID 15 | 7 | 147704200 | 147708382 | 4182 | Gain | 1624 | CNTNAP2 | Ctrl pos High OR | 30.75754113 |
| SEQ ID 15 | 7 | 147704200 | 147708382 | 4182 | Gain | 1626 | CNTNAP2 | Ctrl pos High OR | 30.75754113 |
| SEQ ID 15 | 7 | 147704200 | 147708382 | 4182 | Gain | 1632 | CNTNAP2 | Ctrl pos High OR | 30.75754113 |
| SEQ ID 15 | 7 | 147704200 | 147708382 | 4182 | Gain | 1640 | CNTNAP2 | Ctrl pos High OR | 30.75754113 |
| SEQ ID 15 | 7 | 147704200 | 147708382 | 4182 | Gain | 1641 | CNTNAP2 | Ctrl pos High OR | 30.75754113 |
| SEQ ID 15 | 7 | 147704200 | 147708382 | 4182 | Gain | 1647 | CNTNAP2 | Ctrl pos High OR | 30.75754113 |
| SEQ ID 15 | 7 | 147704200 | 147708382 | 4182 | Gain | 1650 | CNTNAP2 | Ctrl pos High OR | 30.75754113 |
| SEQ ID 15 | 7 | 147704200 | 147708382 | 4182 | Gain | 1653 | CNTNAP2 | Ctrl pos High OR | 30.75754113 |
| SEQ ID 15 | 7 | 147704200 | 147708382 | 4182 | Gain | 1654 | CNTNAP2 | Ctrl pos High OR | 30.75754113 |
| SEQ ID 15 | 7 | 147704200 | 147708382 | 4182 | Gain | 1662 | CNTNAP2 | Ctrl pos High OR | 30.75754113 |
| SEQ ID 15 | 7 | 147704200 | 147708382 | 4182 | Gain | 1667 | CNTNAP2 | Ctrl pos High OR | 30.75754113 |
| SEQ ID 15 | 7 | 147704200 | 147708382 | 4182 | Gain | 1688 | CNTNAP2 | Ctrl pos High OR | 30.75754113 |
| SEQ ID 15 | 7 | 147704200 | 147708382 | 4182 | Gain | 1707 | CNTNAP2 | Ctrl pos High OR | 30.75754113 |
| SEQ ID 15 | 7 | 147704200 | 147708382 | 4182 | Gain | 1708 | CNTNAP2 | Ctrl pos High OR | 30.75754113 |
| SEQ ID 15 | 7 | 147704200 | 147708382 | 4182 | Gain | 1710 | CNTNAP2 | Ctrl pos High OR | 30.75754113 |
| SEQ ID 15 | 7 | 147704200 | 147708382 | 4182 | Gain | 1715 | CNTNAP2 | Ctrl pos High OR | 30.75754113 |
| SEQ ID 15 | 7 | 147704200 | 147708382 | 4182 | Gain | 1720 | CNTNAP2 | Ctrl pos High OR | 30.75754113 |
| SEQ ID 15 | 7 | 147704200 | 147708382 | 4182 | Gain | 1755 | CNTNAP2 | Ctrl pos High OR | 30.75754113 |
| SEQ ID 15 | 7 | 147704200 | 147708382 | 4182 | Gain | 1760 | CNTNAP2 | Ctrl pos High OR | 30.75754113 |
| SEQ ID 15 | 7 | 147704200 | 147708382 | 4182 | Gain | 1774 | CNTNAP2 | Ctrl pos High OR | 30.75754113 |
| SEQ ID 15 | 7 | 147704200 | 147708382 | 4182 | Gain | 1779 | CNTNAP2 | Ctrl pos High OR | 30.75754113 |
| SEQ ID 15 | 7 | 147704200 | 147708382 | 4182 | Gain | 1782 | CNTNAP2 | Ctrl pos High OR | 30.75754113 |
| SEQ ID 15 | 7 | 147704200 | 147708382 | 4182 | Gain | 1783 | CNTNAP2 | Ctrl pos High OR | 30.75754113 |
| SEQ ID 15 | 7 | 147704200 | 147708382 | 4182 | Gain | 1784 | CNTNAP2 | Ctrl pos High OR | 30.75754113 |
| SEQ ID 15 | 7 | 147704200 | 147708382 | 4182 | Gain | 1796 | CNTNAP2 | Ctrl pos High OR | 30.75754113 |
| SEQ ID 15 | 7 | 147704200 | 147708382 | 4182 | Gain | 1804 | CNTNAP2 | Ctrl pos High OR | 30.75754113 |
| SEQ ID 15 | 7 | 147704200 | 147708382 | 4182 | Gain | 1805 | CNTNAP2 | Ctrl pos High OR | 30.75754113 |
| SEQ ID 15 | 7 | 147704200 | 147708382 | 4182 | Gain | 1811 | CNTNAP2 | Ctrl pos High OR | 30.75754113 |
| SEQ ID 15 | 7 | 147704200 | 147708382 | 4182 | Gain | 1813 | CNTNAP2 | Ctrl pos High OR | 30.75754113 |
| SEQ ID 15 | 7 | 147704200 | 147708382 | 4182 | Gain | 1814 | CNTNAP2 | Ctrl pos High OR | 30.75754113 |
| SEQ ID 15 | 7 | 147704200 | 147708382 | 4182 | Gain | 1815 | CNTNAP2 | Ctrl pos High OR | 30.75754113 |
| SEQ ID 15 | 7 | 147704200 | 147708382 | 4182 | Gain | 1818 | CNTNAP2 | Ctrl pos High OR | 30.75754113 |
| SEQ ID 15 | 7 | 147704200 | 147708382 | 4182 | Gain | 1831 | CNTNAP2 | Ctrl pos High OR | 30.75754113 |
| SEQ ID 15 | 7 | 147704200 | 147708382 | 4182 | Gain | 1832 | CNTNAP2 | Ctrl pos High OR | 30.75754113 |
| SEQ ID 15 | 7 | 147704200 | 147708382 | 4182 | Gain | 1835 | CNTNAP2 | Ctrl pos High OR | 30.75754113 |
| SEQ ID 15 | 7 | 147704200 | 147708382 | 4182 | Gain | 1838 | CNTNAP2 | Ctrl pos High OR | 30.75754113 |
| SEQ ID 15 | 7 | 147704200 | 147708382 | 4182 | Gain | 1839 | CNTNAP2 | Ctrl pos High OR | 30.75754113 |
| SEQ ID 15 | 7 | 147704200 | 147708382 | 4182 | Gain | 1845 | CNTNAP2 | Ctrl pos High OR | 30.75754113 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 15 | 7 | 147704200 | 147708382 | 4182 | Gain | 1851 | CNTNAP2 | Ctrl pos High OR | 30.75754113 |
| SEQ ID 15 | 7 | 147704200 | 147708382 | 4182 | Gain | 1861 | CNTNAP2 | Ctrl pos High OR | 30.75754113 |
| SEQ ID 15 | 7 | 147704200 | 147708382 | 4182 | Gain | 1874 | CNTNAP2 | Ctrl pos High OR | 30.75754113 |
| SEQ ID 15 | 7 | 147704200 | 147708382 | 4182 | Gain | 1881 | CNTNAP2 | Ctrl pos High OR | 30.75754113 |
| SEQ ID 15 | 7 | 147704200 | 147708382 | 4182 | Gain | 1883 | CNTNAP2 | Ctrl pos High OR | 30.75754113 |
| SEQ ID 15 | 7 | 147704200 | 147708382 | 4182 | Gain | 1893 | CNTNAP2 | Ctrl pos High OR | 30.75754113 |
| SEQ ID 15 | 7 | 147704200 | 147708382 | 4182 | Gain | 1905 | CNTNAP2 | Ctrl pos High OR | 30.75754113 |
| SEQ ID 15 | 7 | 147704200 | 147708382 | 4182 | Gain | 1927 | CNTNAP2 | Ctrl pos High OR | 30.75754113 |
| SEQ ID 15 | 7 | 147704200 | 147708382 | 4182 | Gain | 1930 | CNTNAP2 | Ctrl pos High OR | 30.75754113 |
| SEQ ID 15 | 7 | 147704200 | 147708382 | 4182 | Gain | 1944 | CNTNAP2 | Ctrl pos High OR | 30.75754113 |
| SEQ ID 15 | 7 | 147704200 | 147708382 | 4182 | Gain | 1948 | CNTNAP2 | Ctrl pos High OR | 30.75754113 |
| SEQ ID 15 | 7 | 147704200 | 147708382 | 4182 | Gain | 1970 | CNTNAP2 | Ctrl pos High OR | 30.75754113 |
| SEQ ID 15 | 7 | 147704200 | 147708382 | 4182 | Gain | 1997 | CNTNAP2 | Ctrl pos High OR | 30.75754113 |
| SEQ ID 15 | 7 | 147704200 | 147708382 | 4182 | Gain | 2024 | CNTNAP2 | Ctrl pos High OR | 30.75754113 |
| SEQ ID 15 | 7 | 147704200 | 147708382 | 4182 | Gain | 2026 | CNTNAP2 | Ctrl pos High OR | 30.75754113 |
| SEQ ID 15 | 7 | 147704200 | 147708382 | 4182 | Gain | 2034 | CNTNAP2 | Ctrl pos High OR | 30.75754113 |
| SEQ ID 38 | 7 | 147704200 | 147711471 | 7271 | Gain | 1423 | CNTNAP2 | Ctrl pos High OR | 30.75754113 |
| SEQ ID 39 | 1 | 85964576 | 85967615 | 3039 | loss | 1266 | COL24A1 | Exon+ve, ≥2 cases | 28.77224736 |
| SEQ ID 39 | 1 | 85964576 | 85967615 | 3039 | loss | 1283 | COL24A1 | Exon+ve, ≥2 cases | 28.77224736 |
| SEQ ID 39 | 1 | 85964576 | 85967615 | 3039 | loss | 1284 | COL24A1 | Exon+ve, ≥2 cases | 28.77224736 |
| SEQ ID 39 | 1 | 85964576 | 85967615 | 3039 | loss | 1308 | COL24A1 | Exon+ve, ≥2 cases | 28.77224736 |
| SEQ ID 39 | 1 | 85964576 | 85967615 | 3039 | loss | 1309 | COL24A1 | Exon+ve, ≥2 cases | 28.77224736 |
| SEQ ID 39 | 1 | 85964576 | 85967615 | 3039 | loss | 1354 | COL24A1 | Exon+ve, ≥2 cases | 28.77224736 |
| SEQ ID 39 | 1 | 85964576 | 85967615 | 3039 | loss | 1413 | COL24A1 | Exon+ve, ≥2 cases | 28.77224736 |
| SEQ ID 39 | 1 | 85964576 | 85967615 | 3039 | loss | 1418 | COL24A1 | Exon+ve, ≥2 cases | 28.77224736 |
| SEQ ID 39 | 1 | 85964576 | 85967615 | 3039 | loss | 1433 | COL24A1 | Exon+ve, ≥2 cases | 28.77224736 |
| SEQ ID 39 | 1 | 85964576 | 85967615 | 3039 | loss | 1449 | COL24A1 | Exon+ve, ≥2 cases | 28.77224736 |
| SEQ ID 39 | 1 | 85964576 | 85967615 | 3039 | loss | 1451 | COL24A1 | Exon+ve, ≥2 cases | 28.77224736 |
| SEQ ID 39 | 1 | 85964576 | 85967615 | 3039 | loss | 1640 | COL24A1 | Exon+ve, ≥2 cases | 28.77224736 |
| SEQ ID 39 | 1 | 85964576 | 85967615 | 3039 | loss | 1781 | COL24A1 | Exon+ve, ≥2 cases | 28.77224736 |
| SEQ ID 39 | 1 | 85964576 | 85967615 | 3039 | loss | 1815 | COL24A1 | Exon+ve, ≥2 cases | 28.77224736 |
| SEQ ID 39 | 1 | 85964576 | 85967615 | 3039 | loss | 1818 | COL24A1 | Exon+ve, ≥2 cases | 28.77224736 |
| SEQ ID 39 | 1 | 85964576 | 85967615 | 3039 | loss | 1929 | COL24A1 | Exon+ve, ≥2 cases | 28.77224736 |
| SEQ ID 39 | 1 | 85964576 | 85967615 | 3039 | loss | 1994 | COL24A1 | Exon+ve, ≥2 cases | 28.77224736 |
| SEQ ID 39 | 1 | 85964576 | 85967615 | 3039 | loss | 2031 | COL24A1 | Exon+ve, ≥2 cases | 28.77224736 |
| SEQ ID 39 | 1 | 85964576 | 85967615 | 3039 | loss | 2040 | COL24A1 | Exon+ve, ≥2 cases | 28.77224736 |
| SEQ ID 40 | 6 | 35853209 | 35862502 | 9293 | loss | 1940 | C6orf27, C6orf126 | Exon+ve, ≥2 cases | 28.77224736 |
| SEQ ID 41 | 6 | 35855652 | 35873335 | 17683 | loss | 1301 | C6orf27, CLPS | Exon+ve, ≥2 cases | 28.77224736 |
| SEQ ID 41 | 6 | 35855652 | 35873335 | 17683 | loss | 1837 | C6orf27, CLPS | Exon+ve, ≥2 cases | 28.77224736 |
| SEQ ID 41 | 6 | 35855652 | 35873335 | 17683 | loss | 1839 | C6orf27, CLPS | Exon+ve, ≥2 cases | 28.77224736 |
| SEQ ID 41 | 6 | 35855652 | 35873335 | 17683 | loss | 1952 | C6orf27, CLPS | Exon+ve, ≥2 cases | 28.77224736 |
| SEQ ID 41 | 6 | 35855652 | 35873335 | 17683 | loss | 1959 | C6orf27, CLPS | Exon+ve, ≥2 cases | 28.77224736 |
| SEQ ID 42 | 6 | 35853209 | 35873335 | 20126 | loss | 1958 | C6orf27, C6orf126, CLPS | Exon+ve, ≥2 cases | 28.77224736 |
| SEQ ID 42 | 6 | 35853209 | 35873335 | 20126 | loss | 1961 | C6orf27, C6orf126, CLPS | Exon+ve, ≥2 cases | 28.77224736 |
| SEQ ID 42 | 6 | 35853209 | 35873335 | 20126 | loss | 1962 | C6orf27, C6orf126, CLPS | Exon+ve, ≥2 cases | 28.77224736 |
| SEQ ID 42 | 6 | 35853209 | 35873335 | 20126 | loss | 2005 | C6orf27, C6orf126, CLPS | Exon+ve, ≥2 cases | 28.77224736 |
| SEQ ID 43 | 6 | 35851495 | 35872078 | 20583 | loss | 1852 | C6orf27, C6orf126, CLPS | Exon+ve, ≥2 cases | 28.77224736 |
| SEQ ID 44 | 6 | 35851495 | 35873335 | 21840 | loss | 1965 | C6orf27, C6orf126, CLPS | Exon+ve, ≥2 cases | 28.77224736 |
| SEQ ID 44 | 6 | 35851495 | 35873335 | 21840 | loss | 2018 | C6orf27, C6orf126, CLPS | Exon+ve, ≥2 cases | 28.77224736 |
| SEQ ID 45 | 6 | 35853209 | 35875112 | 21903 | loss | 1946 | C6orf27, C6orf126, CLPS | Exon+ve, ≥2 cases | 28.77224736 |
| SEQ ID 46 | 6 | 35851495 | 35875112 | 23617 | loss | 1950 | C6orf27, C6orf126, CLPS | Exon+ve, ≥2 cases | 28.77224736 |
| SEQ ID 47 | 6 | 35851495 | 35878656 | 27161 | loss | 2006 | C6orf27, C6orf126, CLPS | Exon+ve, ≥2 cases | 28.77224736 |
| SEQ ID 48 | 6 | 35849860 | 35878656 | 28796 | loss | 1680 | C6orf27, C6orf126, CLPS | Exon+ve, ≥2 cases | 28.77224736 |
| SEQ ID 49 | 6 | 35848099 | 35878656 | 30557 | loss | 1718 | C6orf27, C6orf126, CLPS | Exon+ve, ≥2 cases | 28.77224736 |
| SEQ ID 50 | 6 | 35846772 | 35878656 | 31884 | loss | 1694 | C6orf27, C6orf126, CLPS | Exon+ve, ≥2 cases | 28.77224736 |
| SEQ ID 51 | 12 | 130944468 | 130946248 | 1780 | gain | 1448 | ULK1 | Exon+ve, ≥2 cases | 24.12012012 |
| SEQ ID 51 | 12 | 130944468 | 130946248 | 1780 | loss | 1471 | ULK1 | Exon+ve, ≥2 cases | 24.12012012 |
| SEQ ID 51 | 12 | 130944468 | 130946248 | 1780 | loss | 1474 | ULK1 | Exon+ve, ≥2 cases | 24.12012012 |
| SEQ ID 51 | 12 | 130944468 | 130946248 | 1780 | loss | 1492 | ULK1 | Exon+ve, ≥2 cases | 24.12012012 |
| SEQ ID 51 | 12 | 130944468 | 130946248 | 1780 | loss | 1493 | ULK1 | Exon+ve, ≥2 cases | 24.12012012 |
| SEQ ID 51 | 12 | 130944468 | 130946248 | 1780 | loss | 1496 | ULK1 | Exon+ve, ≥2 cases | 24.12012012 |
| SEQ ID 51 | 12 | 130944468 | 130946248 | 1780 | loss | 1497 | ULK1 | Exon+ve, ≥2 cases | 24.12012012 |
| SEQ ID 51 | 12 | 130944468 | 130946248 | 1780 | loss | 1498 | ULK1 | Exon+ve, ≥2 cases | 24.12012012 |
| SEQ ID 51 | 12 | 130944468 | 130946248 | 1780 | loss | 1500 | ULK1 | Exon+ve, ≥2 cases | 24.12012012 |
| SEQ ID 51 | 12 | 130944468 | 130946248 | 1780 | loss | 1505 | ULK1 | Exon+ve, ≥2 cases | 24.12012012 |
| SEQ ID 51 | 12 | 130944468 | 130946248 | 1780 | loss | 1517 | ULK1 | Exon+ve, ≥2 cases | 24.12012012 |
| SEQ ID 51 | 12 | 130944468 | 130946248 | 1780 | loss | 1566 | ULK1 | Exon+ve, ≥2 cases | 24.12012012 |
| SEQ ID 51 | 12 | 130944468 | 130946248 | 1780 | loss | 1579 | ULK1 | Exon+ve, ≥2 cases | 24.12012012 |
| SEQ ID 51 | 12 | 130944468 | 130946248 | 1780 | loss | 1580 | ULK1 | Exon+ve, ≥2 cases | 24.12012012 |
| SEQ ID 51 | 12 | 130944468 | 130946248 | 1780 | loss | 1582 | ULK1 | Exon+ve, ≥2 cases | 24.12012012 |
| SEQ ID 52 | 12 | 130944468 | 130947790 | 3322 | loss | 1416 | ULK1 | Exon+ve, ≥2 cases | 24.12012012 |
| SEQ ID 53 | 14 | 22946615 | 22947034 | 419 | Loss | 1820 | MYH6 | Ctrl pos High OR | 22.57871064 |
| SEQ ID 54 | 14 | 22946615 | 22947639 | 1024 | Loss | 1718 | MYH6 | Ctrl pos High OR | 22.57871064 |
| SEQ ID 54 | 14 | 22946615 | 22947639 | 1024 | Loss | 1802 | MYH6 | Ctrl pos High OR | 22.57871064 |
| SEQ ID 54 | 14 | 22946615 | 22947639 | 1024 | Loss | 1816 | MYH6 | Ctrl pos High OR | 22.57871064 |
| SEQ ID 54 | 14 | 22946615 | 22947639 | 1024 | Loss | 1817 | MYH6 | Ctrl pos High OR | 22.57871064 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 54 | 14 | 22946615 | 22947639 | 1024 | Loss | 1819 | MYH6 | Ctrl pos High OR | 22.57871064 |
| SEQ ID 54 | 14 | 22946615 | 22947639 | 1024 | Loss | 1850 | MYH6 | Ctrl pos High OR | 22.57871064 |
| SEQ ID 54 | 14 | 22946615 | 22947639 | 1024 | Loss | 1895 | MYH6 | Ctrl pos High OR | 22.57871064 |
| SEQ ID 54 | 14 | 22946615 | 22947639 | 1024 | Loss | 1993 | MYH6 | Ctrl pos High OR | 22.57871064 |
| SEQ ID 54 | 14 | 22946615 | 22947639 | 1024 | Loss | 2043 | MYH6 | Ctrl pos High OR | 22.57871064 |
| SEQ ID 55 | 14 | 22943262 | 22951086 | 7824 | Loss | 1577 | MYH6 | Ctrl pos High OR | 22.57871064 |
| SEQ ID 56 | 14 | 22946615 | 22955470 | 8855 | Loss | 2032 | MYH6, MYH7 | Ctrl pos High OR | 22.57871064 |
| SEQ ID 57 | 14 | 22943262 | 22955470 | 12208 | Loss | 1856 | MYH6, MYH7 | Ctrl pos High OR | 22.57871064 |
| SEQ ID 58 | 14 | 22929952 | 22958797 | 28845 | Loss | 1537 | MIR208B, MYH6, MYH7 | Ctrl pos High OR | 22.57871064 |
| SEQ ID 59 | 14 | 22929952 | 22959469 | 29517 | Loss | 1669 | MIR208B, MYH6, MYH7 | Ctrl pos High OR | 22.57871064 |
| SEQ ID 60 | 7 | 142027745 | 142152205 | 124460 | loss | 1568 | PRSS1, MTRNR2L6 | Exon+ve, ≥2 cases | 22.57871064 |
| SEQ ID 60 | 7 | 142027745 | 142152205 | 124460 | loss | 1753 | PRSS1, MTRNR2L6 | Exon+ve, ≥2 cases | 22.57871064 |
| SEQ ID 61 | 7 | 142021348 | 142152205 | 130857 | loss | 1347 | PRSS1, MTRNR2L6 | Exon+ve, ≥2 cases | 22.57871064 |
| SEQ ID 62 | 7 | 142009000 | 142140540 | 131540 | loss | 2018 | PRSS1, MTRNR2L6 | Exon+ve, ≥2 cases | 22.57871064 |
| SEQ ID 63 | 7 | 142018368 | 142152205 | 133837 | loss | 1349 | PRSS1, MTRNR2L6 | Exon+ve, ≥2 cases | 22.57871064 |
| SEQ ID 63 | 7 | 142018368 | 142152205 | 133837 | loss | 1374 | PRSS1, MTRNR2L6 | Exon+ve, ≥2 cases | 22.57871064 |
| SEQ ID 63 | 7 | 142018368 | 142152205 | 133837 | loss | 1697 | PRSS1, MTRNR2L6 | Exon+ve, ≥2 cases | 22.57871064 |
| SEQ ID 64 | 7 | 142007171 | 142152205 | 145034 | loss | 1242 | PRSS1, MTRNR2L6 | Exon+ve, ≥2 cases | 22.57871064 |
| SEQ ID 65 | 7 | 142005505 | 142152205 | 146700 | loss | 1601 | PRSS1, MTRNR2L6 | Exon+ve, ≥2 cases | 22.57871064 |
| SEQ ID 66 | 7 | 142041787 | 142205830 | 164043 | loss | 1837 | PRSS1, TRY6, PRSS2, MTRNR2L6 | Exon+ve, ≥2 cases | 22.57871064 |
| SEQ ID 67 | 7 | 142018368 | 142202274 | 183906 | loss | 1784 | PRSS1, TRY6, PRSS2, MTRNR2L6 | Exon+ve, ≥2 cases | 22.57871064 |
| SEQ ID 68 | 7 | 142009000 | 142205830 | 196830 | loss | 2024 | PRSS1, TRY6, PRSS2, MTRNR2L6 | Exon+ve, ≥2 cases | 22.57871064 |
| SEQ ID 69 | 7 | 141993718 | 142207147 | 213429 | loss | 1930 | PRSS1, TRY6, PRSS2, MTRNR2L6 | Exon+ve, ≥2 cases | 22.57871064 |
| SEQ ID 70 | 7 | 141989750 | 142205830 | 216080 | loss | 1803 | PRSS1, TRY6, PRSS2, MTRNR2L6 | Exon+ve, ≥2 cases | 22.57871064 |
| SEQ ID 71 | 7 | 141953817 | 142205830 | 252013 | loss | 1232 | PRSS1, TRY6, PRSS2, MTRNR2L6 | Exon+ve, ≥2 cases | 22.57871064 |
| SEQ ID 72 | 19 | 14666403 | 14667646 | 1243 | loss | 1677 | ZNF333 | Exon+ve, ≥2 cases | 17.98208955 |
| SEQ ID 72 | 19 | 14666403 | 14667646 | 1243 | loss | 1738 | ZNF333 | Exon+ve, ≥2 cases | 17.98208955 |
| SEQ ID 72 | 19 | 14666403 | 14667646 | 1243 | loss | 1775 | ZNF333 | Exon+ve, ≥2 cases | 17.98208955 |
| SEQ ID 72 | 19 | 14666403 | 14667646 | 1243 | loss | 1826 | ZNF333 | Exon+ve, ≥2 cases | 17.98208955 |
| SEQ ID 72 | 19 | 14666403 | 14667646 | 1243 | loss | 1837 | ZNF333 | Exon+ve, ≥2 cases | 17.98208955 |
| SEQ ID 72 | 19 | 14666403 | 14667646 | 1243 | loss | 1957 | ZNF333 | Exon+ve, ≥2 cases | 17.98208955 |
| SEQ ID 72 | 19 | 14666403 | 14667646 | 1243 | loss | 1968 | ZNF333 | Exon+ve, ≥2 cases | 17.98208955 |
| SEQ ID 72 | 19 | 14666403 | 14667646 | 1243 | loss | 2004 | ZNF333 | Exon+ve, ≥2 cases | 17.98208955 |
| SEQ ID 72 | 19 | 14666403 | 14667646 | 1243 | loss | 2031 | ZNF333 | Exon+ve, ≥2 cases | 17.98208955 |
| SEQ ID 73 | 19 | 14665135 | 14667646 | 2511 | loss | 1416 | ZNF333 | Exon+ve, ≥2 cases | 17.98208955 |
| SEQ ID 73 | 19 | 14665135 | 14667646 | 2511 | loss | 1578 | ZNF333 | Exon+ve, ≥2 cases | 17.98208955 |
| SEQ ID 73 | 19 | 14665135 | 14667646 | 2511 | loss | 1881 | ZNF333 | Exon+ve, ≥2 cases | 17.98208955 |
| SEQ ID 74 | 5 | 122534134 | 122535395 | 1261 | loss | 1224 | PRDM6 | Exon+ve, ≥2 cases | 16.45901639 |
| SEQ ID 74 | 5 | 122534134 | 122535395 | 1261 | loss | 1548 | PRDM6 | Exon+ve, ≥2 cases | 16.45901639 |
| SEQ ID 74 | 5 | 122534134 | 122535395 | 1261 | loss | 1552 | PRDM6 | Exon+ve, ≥2 cases | 16.45901639 |
| SEQ ID 74 | 5 | 122534134 | 122535395 | 1261 | loss | 1681 | PRDM6 | Exon+ve, ≥2 cases | 16.45901639 |
| SEQ ID 74 | 5 | 122534134 | 122535395 | 1261 | loss | 1740 | PRDM6 | Exon+ve, ≥2 cases | 16.45901639 |
| SEQ ID 74 | 5 | 122534134 | 122535395 | 1261 | loss | 1763 | PRDM6 | Exon+ve, ≥2 cases | 16.45901639 |
| SEQ ID 74 | 5 | 122534134 | 122535395 | 1261 | loss | 1786 | PRDM6 | Exon+ve, ≥2 cases | 16.45901639 |
| SEQ ID 74 | 5 | 122534134 | 122535395 | 1261 | loss | 1807 | PRDM6 | Exon+ve, ≥2 cases | 16.45901639 |
| SEQ ID 74 | 5 | 122534134 | 122535395 | 1261 | loss | 1880 | PRDM6 | Exon+ve, ≥2 cases | 16.45901639 |
| SEQ ID 74 | 5 | 122534134 | 122535395 | 1261 | loss | 1881 | PRDM6 | Exon+ve, ≥2 cases | 16.45901639 |
| SEQ ID 74 | 5 | 122534134 | 122535395 | 1261 | loss | 1915 | PRDM6 | Exon+ve, ≥2 cases | 16.45901639 |
| SEQ ID 75 | 2 | 10263146 | 10272211 | 9065 | loss | 1256 | C2orf48 | Exon+ve, ≥2 cases | 14.94047619 |
| SEQ ID 75 | 2 | 10263146 | 10272211 | 9065 | loss | 1285 | C2orf48 | Exon+ve, ≥2 cases | 14.94047619 |
| SEQ ID 75 | 2 | 10263146 | 10272211 | 9065 | loss | 1370 | C2orf48 | Exon+ve, ≥2 cases | 14.94047619 |
| SEQ ID 75 | 2 | 10263146 | 10272211 | 9065 | loss | 1396 | C2orf48 | Exon+ve, ≥2 cases | 14.94047619 |
| SEQ ID 76 | 6 | 33495074 | 33505974 | 10900 | loss | 1824 | SYNGAP1 | Exon+ve, ≥2 cases | 14.94047619 |
| SEQ ID 76 | 6 | 33495074 | 33505974 | 10900 | loss | 1840 | SYNGAP1 | Exon+ve, ≥2 cases | 14.94047619 |
| SEQ ID 77 | 2 | 10263146 | 10274556 | 11410 | loss | 1307 | C2orf48 | Exon+ve, ≥2 cases | 14.94047619 |
| SEQ ID 77 | 2 | 10263146 | 10274556 | 11410 | loss | 1415 | C2orf48 | Exon+ve, ≥2 cases | 14.94047619 |
| SEQ ID 77 | 2 | 10263146 | 10274556 | 11410 | loss | 1616 | C2orf48 | Exon+ve, ≥2 cases | 14.94047619 |
| SEQ ID 77 | 2 | 10263146 | 10274556 | 11410 | loss | 1654 | C2orf48 | Exon+ve, ≥2 cases | 14.94047619 |
| SEQ ID 77 | 2 | 10263146 | 10274556 | 11410 | loss | 1830 | C2orf48 | Exon+ve, ≥2 cases | 14.94047619 |
| SEQ ID 77 | 2 | 10263146 | 10274556 | 11410 | loss | 1931 | C2orf48 | Exon+ve, ≥2 cases | 14.94047619 |
| SEQ ID 78 | 6 | 33491109 | 33504619 | 13510 | loss | 1718 | SYNGAP1, CUTA, PHF1 | Exon+ve, ≥2 cases | 14.94047619 |
| SEQ ID 78 | 6 | 33491109 | 33504619 | 13510 | loss | 2032 | SYNGAP1, CUTA, PHF1 | Exon+ve, ≥2 cases | 14.94047619 |
| SEQ ID 79 | 6 | 33492394 | 33505974 | 13580 | loss | 1872 | SYNGAP1, CUTA | Exon+ve, ≥2 cases | 14.94047619 |
| SEQ ID 79 | 6 | 33492394 | 33505974 | 13580 | loss | 1967 | SYNGAP1, CUTA | Exon+ve, ≥2 cases | 14.94047619 |
| SEQ ID 80 | 6 | 33491109 | 33505974 | 14865 | loss | 1905 | SYNGAP1, CUTA, PHF1 | Exon+ve, ≥2 cases | 14.94047619 |
| SEQ ID 80 | 6 | 33491109 | 33505974 | 14865 | loss | 2031 | SYNGAP1, CUTA, PHF1 | Exon+ve, ≥2 cases | 14.94047619 |
| SEQ ID 81 | 6 | 33491109 | 33507587 | 16478 | loss | 1297 | SYNGAP1, CUTA, PHF1 | Exon+ve, ≥2 cases | 14.94047619 |
| SEQ ID 82 | 11 | 5742476 | 5774108 | 31632 | gain | 1394 | OR52N5, OR52N1 | Exon+ve, ≥2 cases | 14.94047619 |
| SEQ ID 82 | 11 | 5742476 | 5774108 | 31632 | gain | 1536 | OR52N5, OR52N1 | Exon+ve, ≥2 cases | 14.94047619 |
| SEQ ID 82 | 11 | 5742476 | 5774108 | 31632 | gain | 1821 | OR52N5, OR52N1 | Exon+ve, ≥2 cases | 14.94047619 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 82 | 11 | 5742476 | 5774108 | 31632 | gain | 1825 | OR52N5, OR52N1 | Exon+ve, ≥2 cases | 14.94047619 |
| SEQ ID 82 | 11 | 5742476 | 5774108 | 31632 | gain | 1902 | OR52N5, OR52N1 | Exon+ve, ≥2 cases | 14.94047619 |
| SEQ ID 83 | 11 | 5742476 | 5775970 | 33494 | gain | 1538 | OR52N5, OR52N1 | Exon+ve, ≥2 cases | 14.94047619 |
| SEQ ID 83 | 11 | 5742476 | 5775970 | 33494 | gain | 1551 | OR52N5, OR52N1 | Exon+ve, ≥2 cases | 14.94047619 |
| SEQ ID 83 | 11 | 5742476 | 5775970 | 33494 | gain | 1727 | OR52N5, OR52N1 | Exon+ve, ≥2 cases | 14.94047619 |
| SEQ ID 83 | 11 | 5742476 | 5775970 | 33494 | gain | 1823 | OR52N5, OR52N1 | Exon+ve, ≥2 cases | 14.94047619 |
| SEQ ID 83 | 11 | 5742476 | 5775970 | 33494 | gain | 1824 | OR52N5, OR52N1 | Exon+ve, ≥2 cases | 14.94047619 |
| SEQ ID 84 | 6 | 33400195 | 33511247 | 111052 | loss | 1841 | SYNGAP1, PHF1, CUTA, KIFC1 | Exon+ve, ≥2 cases | 14.94047619 |
| SEQ ID 85 | 19 | 59174756 | 59183718 | 8962 | loss | 1859 | CACNG8, MIR935 | Exon+ve, ≥2 cases | 13.42644874 |
| SEQ ID 86 | 10 | 131651597 | 131652807 | 1210 | loss | 1572 | EBF3 | Exon+ve, ≥2 cases | 11.91691395 |
| SEQ ID 86 | 10 | 131651597 | 131652807 | 1210 | gain | 1597 | EBF3 | Exon+ve, ≥2 cases | 11.91691395 |
| SEQ ID 86 | 10 | 131651597 | 131652807 | 1210 | gain | 1644 | EBF3 | Exon+ve, ≥2 cases | 11.91691395 |
| SEQ ID 86 | 10 | 131651597 | 131652807 | 1210 | loss | 1691 | EBF3 | Exon+ve, ≥2 cases | 11.91691395 |
| SEQ ID 86 | 10 | 131651597 | 131652807 | 1210 | loss | 1703 | EBF3 | Exon+ve, ≥2 cases | 11.91691395 |
| SEQ ID 86 | 10 | 131651597 | 131652807 | 1210 | loss | 1704 | EBF3 | Exon+ve, ≥2 cases | 11.91691395 |
| SEQ ID 86 | 10 | 131651597 | 131652807 | 1210 | gain | 1709 | EBF3 | Exon+ve, ≥2 cases | 11.91691395 |
| SEQ ID 86 | 10 | 131651597 | 131652807 | 1210 | loss | 1724 | EBF3 | Exon+ve, ≥2 cases | 11.91691395 |
| SEQ ID 87 | 15 | 54513726 | 54522863 | 9137 | loss | 1237 | TEX9, MNS1 | Exon+ve, ≥2 cases | 11.91691395 |
| SEQ ID 87 | 15 | 54513726 | 54522863 | 9137 | loss | 1347 | TEX9, MNS1 | Exon+ve, ≥2 cases | 11.91691395 |
| SEQ ID 87 | 15 | 54513726 | 54522863 | 9137 | loss | 1441 | TEX9, MNS1 | Exon+ve, ≥2 cases | 11.91691395 |
| SEQ ID 87 | 15 | 54513726 | 54522863 | 9137 | loss | 1456 | TEX9, MNS1 | Exon+ve, ≥2 cases | 11.91691395 |
| SEQ ID 87 | 15 | 54513726 | 54522863 | 9137 | loss | 1494 | TEX9, MNS1 | Exon+ve, ≥2 cases | 11.91691395 |
| SEQ ID 87 | 15 | 54513726 | 54522863 | 9137 | loss | 1496 | TEX9, MNS1 | Exon+ve, ≥2 cases | 11.91691395 |
| SEQ ID 87 | 15 | 54513726 | 54522863 | 9137 | loss | 1997 | TEX9, MNS1 | Exon+ve, ≥2 cases | 11.91691395 |
| SEQ ID 88 | 15 | 54513726 | 54523657 | 9931 | loss | 1497 | TEX9, MNS1 | Exon+ve, ≥2 cases | 11.91691395 |
| SEQ ID 89 | 5 | 10683077 | 10691335 | 8258 | loss | 1438 | ANKRD33B | Exon+ve, ≥2 cases | 11.91691395 |
| SEQ ID 89 | 5 | 10683077 | 10691335 | 8258 | loss | 1619 | ANKRD33B | Exon+ve, ≥2 cases | 11.91691395 |
| SEQ ID 89 | 5 | 10683077 | 10691335 | 8258 | loss | 1629 | ANKRD33B | Exon+ve, ≥2 cases | 11.91691395 |
| SEQ ID 89 | 5 | 10683077 | 10691335 | 8258 | loss | 1630 | ANKRD33B | Exon+ve, ≥2 cases | 11.91691395 |
| SEQ ID 89 | 5 | 10683077 | 10691335 | 8258 | loss | 1998 | ANKRD33B | Exon+ve, ≥2 cases | 11.91691395 |
| SEQ ID 89 | 5 | 10683077 | 10691335 | 8258 | loss | 2026 | ANKRD33B | Exon+ve, ≥2 cases | 11.91691395 |
| SEQ ID 90 | 6 | 143693693 | 143705189 | 11496 | gain | 1372 | AIG1 | Exon+ve, ≥2 cases | 11.91691395 |
| SEQ ID 91 | 6 | 143692365 | 143705189 | 12824 | gain | 1281 | AIG1 | Exon+ve, ≥2 cases | 11.91691395 |
| SEQ ID 92 | 5 | 10677114 | 10699881 | 22767 | loss | 1666 | ANKRD33B | Exon+ve, ≥2 cases | 11.91691395 |
| SEQ ID 93 | 5 | 9279249 | 12716482 | 3437233 | loss | 1850 | TAG, CMBL, SEMA5A, FAM173B, ROPN1L, CCT5, LOC285692, MARCH6, DAP, CTNND2, SNORD123, ANKRD33B, TAS2R1 | Exon+ve, ≥2 cases | 11.91691395 |
| SEQ ID 94 | 6 | 143697902 | 143705189 | 7287 | gain | 1905 | AIG1 | Exon+ve, ≥2 cases | 11.91691395 |
| SEQ ID 95 | 6 | 143696259 | 143705189 | 8930 | gain | 1429 | AIG1 | Exon+ve, ≥2 cases | 11.91691395 |
| SEQ ID 95 | 6 | 143696259 | 143705189 | 8930 | gain | 1926 | AIG1 | Exon+ve, ≥2 cases | 11.91691395 |
| SEQ ID 90 | 6 | 143693693 | 143705189 | 11496 | gain | 1409 | AIG1 | Exon+ve, ≥2 cases | 11.91691395 |
| SEQ ID 90 | 6 | 143693693 | 143705189 | 11496 | gain | 1619 | AIG1 | Exon+ve, ≥2 cases | 11.91691395 |
| SEQ ID 90 | 6 | 143693693 | 143705189 | 11496 | gain | 1639 | AIG1 | Exon+ve, ≥2 cases | 11.91691395 |
| SEQ ID 96 | 16 | 5047987 | 5049746 | 1759 | loss | 1419 | C16orf89 | Exon+ve, ≥2 cases | 10.41185185 |
| SEQ ID 97 | 12 | 95110503 | 95112470 | 1967 | loss | 1447 | ELK3 | Exon+ve, ≥2 cases | 10.41185185 |
| SEQ ID 97 | 12 | 95110503 | 95112470 | 1967 | loss | 1728 | ELK3 | Exon+ve, ≥2 cases | 10.41185185 |
| SEQ ID 97 | 12 | 95110503 | 95112470 | 1967 | loss | 1742 | ELK3 | Exon+ve, ≥2 cases | 10.41185185 |
| SEQ ID 97 | 12 | 95110503 | 95112470 | 1967 | loss | 1957 | ELK3 | Exon+ve, ≥2 cases | 10.41185185 |
| SEQ ID 97 | 12 | 95110503 | 95112470 | 1967 | loss | 1961 | ELK3 | Exon+ve, ≥2 cases | 10.41185185 |
| SEQ ID 97 | 12 | 95110503 | 95112470 | 1967 | loss | 1965 | ELK3 | Exon+ve, ≥2 cases | 10.41185185 |
| SEQ ID 97 | 12 | 95110503 | 95112470 | 1967 | loss | 1967 | ELK3 | Exon+ve, ≥2 cases | 10.41185185 |
| SEQ ID 98 | 11 | 43920001 | 43921971 | 1970 | gain | 1324 | C11orf96 | Exon+ve, ≥2 cases | 10.41185185 |
| SEQ ID 98 | 11 | 43920001 | 43921971 | 1970 | loss | 1396 | C11orf96 | Exon+ve, ≥2 cases | 10.41185185 |
| SEQ ID 98 | 11 | 43920001 | 43921971 | 1970 | gain | 1530 | C11orf96 | Exon+ve, ≥2 cases | 10.41185185 |
| SEQ ID 98 | 11 | 43920001 | 43921971 | 1970 | loss | 1829 | C11orf96 | Exon+ve, ≥2 cases | 10.41185185 |
| SEQ ID 98 | 11 | 43920001 | 43921971 | 1970 | gain | 1860 | C11orf96 | Exon+ve, ≥2 cases | 10.41185185 |
| SEQ ID 98 | 11 | 43920001 | 43921971 | 1970 | loss | 1874 | C11orf96 | Exon+ve, ≥2 cases | 10.41185185 |
| SEQ ID 98 | 11 | 43920001 | 43921971 | 1970 | gain | 1996 | C11orf96 | Exon+ve, ≥2 cases | 10.41185185 |
| SEQ ID 99 | 16 | 3868512 | 3870705 | 2193 | loss | 1590 | CREBBP | Exon+ve, ≥2 cases | 10.41185185 |
| SEQ ID 100 | 16 | 3868512 | 3872218 | 3706 | loss | 1533 | CREBBP | Exon+ve, ≥2 cases | 10.41185185 |
| SEQ ID 100 | 16 | 3868512 | 3872218 | 3706 | loss | 1539 | CREBBP | Exon+ve, ≥2 cases | 10.41185185 |
| SEQ ID 101 | 14 | 73058103 | 73061942 | 3839 | loss | 1676 | HEATR4 | Exon+ve, ≥2 cases | 10.41185185 |
| SEQ ID 102 | 14 | 73010755 | 73015309 | 4554 | loss | 1806 | HEATR4 | Exon+ve, ≥2 cases | 10.41185185 |
| SEQ ID 103 | 16 | 4187745 | 4192873 | 5128 | loss | 1442 | SRL | Exon+ve, ≥2 cases | 10.41185185 |
| SEQ ID 104 | 16 | 79735089 | 79744613 | 9524 | loss | 1275 | PKD1L2 | Exon+ve, ≥2 cases | 10.41185185 |
| SEQ ID 104 | 16 | 79735089 | 79744613 | 9524 | loss | 1998 | PKD1L2 | Exon+ve, ≥2 cases | 10.41185185 |
| SEQ ID 105 | 11 | 47142460 | 47155662 | 13202 | loss | 1798 | C11orf49, ARFGAP2, PACSIN3 | Exon+ve, ≥2 cases | 10.41185185 |
| SEQ ID 105 | 11 | 47142460 | 47155662 | 13202 | loss | 1852 | C11orf49, ARFGAP2, PACSIN3 | Exon+ve, ≥2 cases | 10.41185185 |
| SEQ ID 105 | 11 | 47142460 | 47155662 | 13202 | loss | 1854 | C11orf49, ARFGAP2, PACSIN3 | Exon+ve, ≥2 cases | 10.41185185 |
| SEQ ID 105 | 11 | 47142460 | 47155662 | 13202 | loss | 1855 | C11orf49, ARFGAP2, PACSIN3 | Exon+ve, ≥2 cases | 10.41185185 |
| SEQ ID 105 | 11 | 47142460 | 47155662 | 13202 | loss | 1857 | C11orf49, ARFGAP2, PACSIN3 | Exon+ve, ≥2 cases | 10.41185185 |
| SEQ ID 105 | 11 | 47142460 | 47155662 | 13202 | loss | 1936 | C11orf49, ARFGAP2, PACSIN3 | Exon+ve, ≥2 cases | 10.41185185 |
| SEQ ID 105 | 11 | 47142460 | 47155662 | 13202 | loss | 2031 | C11orf49, ARFGAP2, PACSIN3 | Exon+ve, ≥2 cases | 10.41185185 |
| SEQ ID 106 | 14 | 73058103 | 73071404 | 13301 | loss | 1687 | HEATR4 | Exon+ve, ≥2 cases | 10.41185185 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 107 | 16 | 79747298 | 79761753 | 14455 | gain | 1252 | PKD1L2 | Exon+ve, ≥2 cases | 10.41185185 |
| SEQ ID 108 | 16 | 79730151 | 79744613 | 14462 | loss | 1404 | PKD1L2 | Exon+ve, ≥2 cases | 10.41185185 |
| SEQ ID 109 | 14 | 73051686 | 73071404 | 19718 | loss | 1237 | HEATR4 | Exon+ve, ≥2 cases | 10.41185185 |
| SEQ ID 110 | X | 2768213 | 2788489 | 20276 | loss | 1654 | GYG2 | Exon+ve, ≥2 cases | 10.41185185 |
| SEQ ID 111 | 16 | 79684548 | 79713478 | 28930 | gain | 1763 | PKD1L2, LOC100329108, GCSH | Exon+ve, distinct CNVs, same Gene | 10.41185185 |
| SEQ ID 112 | 16 | 4554395 | 4588011 | 33616 | loss | 1689 | LOC342346 | Exon+ve, ≥2 cases | 10.41185185 |
| SEQ ID 113 | 14 | 73058103 | 73092112 | 34009 | loss | 1721 | HEATR4, ACOT1 | Exon+ve, ≥2 cases | 10.41185185 |
| SEQ ID 114 | 2 | 73732303 | 73770615 | 38312 | gain | 1533 | ALMS1P | Exon+ve, ≥2 cases | 10.41185185 |
| SEQ ID 114 | 2 | 73732303 | 73770615 | 38312 | loss | 1738 | ALMS1P | Exon+ve, ≥2 cases | 10.41185185 |
| SEQ ID 115 | 2 | 73732303 | 73785403 | 53100 | gain | 1887 | NAT8B, ALMS1P | Exon+ve, ≥2 cases | 10.41185185 |
| SEQ ID 116 | 14 | 73058103 | 73112042 | 53939 | loss | 1718 | HEATR4, ACOT2, ACOT1 | Exon+ve, ≥2 cases | 10.41185185 |
| SEQ ID 117 | 2 | 73706727 | 73764497 | 57770 | loss | 1369 | NAT8, ALMS1P | Exon+ve, ≥2 cases | 10.41185185 |
| SEQ ID 117 | 2 | 73706727 | 73764497 | 57770 | gain | 1626 | NAT8, ALMS1P | Exon+ve, ≥2 cases | 10.41185185 |
| SEQ ID 118 | 2 | 73706727 | 73766459 | 59732 | loss | 1551 | NAT8, ALMS1P | Exon+ve, ≥2 cases | 10.41185185 |
| SEQ ID 118 | 2 | 73706727 | 73766459 | 59732 | loss | 1728 | NAT8, ALMS1P | Exon+ve, ≥2 cases | 10.41185185 |
| SEQ ID 119 | 16 | 79735089 | 79817743 | 82654 | gain | 1917 | PKD1L2 | Exon+ve, ≥2 cases | 10.41185185 |
| SEQ ID 120 | 14 | 72995201 | 73092112 | 96911 | gain | 1291 | HEATR4, C14orf169, ACOT1 | Exon+ve, ≥2 cases | 10.41185185 |
| SEQ ID 121 | X | 2705378 | 2814330 | 108952 | gain | 1509 | XG, GYG2 | Exon+ve, ≥2 cases | 10.41185185 |
| SEQ ID 121 | X | 2705378 | 2814330 | 108952 | gain | 1732 | XG, GYG2 | Exon+ve, ≥2 cases | 10.41185185 |
| SEQ ID 121 | X | 2705378 | 2814330 | 108952 | gain | 1825 | XG, GYG2 | Exon+ve, ≥2 cases | 10.41185185 |
| SEQ ID 122 | X | 2705374 | 2814330 | 108956 | gain | 1434 | XG, GYG2 | Exon+ve, ≥2 cases | 10.41185185 |
| SEQ ID 123 | 16 | 79758150 | 79903976 | 145826 | gain | 1459 | PKD1L2, BCMO1 | Exon+ve, ≥2 cases | 10.41185185 |
| SEQ ID 124 | X | 2554044 | 2747802 | 193758 | gain | 1917 | XGPY2, CD99P1, XG, CD99 | Exon+ve, ≥2 cases | 10.41185185 |
| SEQ ID 125 | X | 2749116 | 3191663 | 442547 | gain | 1917 | ARSD, ARSE, ARSF, ARSH, GYG2 | Exon+ve, ≥2 cases | 10.41185185 |
| SEQ ID 126 | 16 | 3361009 | 5067233 | 1706224 | gain | 1567 | CLUAP1, NAGPA, CORO7-PAM16, GLIS2, ALG1, ROGDI, SEC14L5, C16orf5, ZNF597, NUDT16L1, GLYR1, LOC440335, UBN1, CORO7, C16orf89, LOC342346, SLX4, TRAP1, DNASE1, PPL, ZNF434, PAM16, ANKS3, FAM100A, NLRC3, MTRNR2L4, C16orf71, VASN, NMRAL1, SRL, NAT15, DNAJA3, TFAP4, ZNF174, ADCY9, HMOX2, C16orf90, ZNF500, SEPT12, MGRN1, CREBBP | Exon+ve, ≥2 cases | 10.41185185 |
| SEQ ID 127 | 15 | 73680498 | 73686655 | 6157 | loss | 1773 | SNUPN | Exon+ve, ≥2 cases | 8.911242604 |
| SEQ ID 128 | 15 | 73443782 | 73460290 | 16508 | gain | 1301 | MAN2C1, SIN3A | Exon+ve, ≥2 cases | 8.911242604 |
| SEQ ID 129 | 15 | 73661881 | 73759785 | 97904 | gain | 2018 | IMP3, SNX33, SNUPN, CSPG4 | Exon+ve, ≥2 cases | 8.911242604 |
| SEQ ID 130 | 15 | 72804753 | 72806259 | 1506 | gain | 1309 | CYP1A1 | Exon+ve, ≥2 cases | 8.911242604 |
| SEQ ID 131 | 10 | 25049572 | 25051425 | 1853 | loss | 1548 | ARHGAP21 | Exon+ve, ≥2 cases | 8.911242604 |
| SEQ ID 131 | 10 | 25049572 | 25051425 | 1853 | loss | 1699 | ARHGAP21 | Exon+ve, ≥2 cases | 8.911242604 |
| SEQ ID 131 | 10 | 25049572 | 25051425 | 1853 | loss | 1724 | ARHGAP21 | Exon+ve, ≥2 cases | 8.911242604 |
| SEQ ID 131 | 10 | 25049572 | 25051425 | 1853 | loss | 1961 | ARHGAP21 | Exon+ve, ≥2 cases | 8.911242604 |
| SEQ ID 132 | 10 | 25049572 | 25057232 | 7660 | gain | 1401 | ARHGAP21 | Exon+ve, ≥2 cases | 8.911242604 |
| SEQ ID 132 | 10 | 25049572 | 25057232 | 7660 | gain | 1820 | ARHGAP21 | Exon+ve, ≥2 cases | 8.911242604 |
| SEQ ID 133 | 15 | 71247339 | 71258333 | 10994 | gain | 1293 | NEO1 | Exon+ve, ≥2 cases | 8.911242604 |
| SEQ ID 134 | 6 | 139638465 | 139651247 | 12782 | loss | 1387 | TXLNB | Exon+ve, ≥2 cases | 8.911242604 |
| SEQ ID 134 | 6 | 139638465 | 139651247 | 12782 | loss | 1396 | TXLNB | Exon+ve, ≥2 cases | 8.911242604 |
| SEQ ID 134 | 6 | 139638465 | 139651247 | 12782 | loss | 1696 | TXLNB | Exon+ve, ≥2 cases | 8.911242604 |
| SEQ ID 135 | 6 | 139635466 | 139648318 | 12852 | loss | 1403 | TXLNB | Exon+ve, ≥2 cases | 8.911242604 |
| SEQ ID 135 | 6 | 139635466 | 139648318 | 12852 | loss | 1895 | TXLNB | Exon+ve, ≥2 cases | 8.911242604 |
| SEQ ID 136 | 6 | 139635466 | 139651247 | 15781 | loss | 1401 | TXLNB | Exon+ve, ≥2 cases | 8.911242604 |
| SEQ ID 137 | 7 | 100166257 | 100183859 | 17602 | loss | 1896 | ZAN | Exon+ve, ≥2 cases | 8.911242604 |
| SEQ ID 138 | 1 | 151028700 | 151047260 | 18560 | gain | 1587 | LCE1D, LCE1C | Exon+ve, ≥2 cases | 8.911242604 |
| SEQ ID 138 | 1 | 151028700 | 151047260 | 18560 | gain | 1695 | LCE1D, LCE1C | Exon+ve, ≥2 cases | 8.911242604 |
| SEQ ID 139 | 7 | 100162851 | 100183859 | 21008 | loss | 1227 | ZAN | Exon+ve, ≥2 cases | 8.911242604 |
| SEQ ID 139 | 7 | 100162851 | 100183859 | 21008 | loss | 1236 | ZAN | Exon+ve, ≥2 cases | 8.911242604 |
| SEQ ID 139 | 7 | 100162851 | 100183859 | 21008 | loss | 1803 | ZAN | Exon+ve, ≥2 cases | 8.911242604 |
| SEQ ID 139 | 7 | 100162851 | 100183859 | 21008 | loss | 1824 | ZAN | Exon+ve, ≥2 cases | 8.911242604 |
| SEQ ID 139 | 7 | 100162851 | 100183859 | 21008 | loss | 2034 | ZAN | Exon+ve, ≥2 cases | 8.911242604 |
| SEQ ID 140 | 1 | 151028700 | 151050046 | 21346 | gain | 1223 | LCE1D, LCE1C | Exon+ve, ≥2 cases | 8.911242604 |
| SEQ ID 140 | 1 | 151028700 | 151050046 | 21346 | gain | 1664 | LCE1D, LCE1C | Exon+ve, ≥2 cases | 8.911242604 |
| SEQ ID 140 | 1 | 151028700 | 151050046 | 21346 | gain | 1740 | LCE1D, LCE1C | Exon+ve, ≥2 cases | 8.911242604 |
| SEQ ID 141 | 1 | 151026228 | 151050046 | 23818 | gain | 1936 | LCE1D, LCE1E, LCE1C | Exon+ve, ≥2 cases | 8.911242604 |
| SEQ ID 142 | 15 | 69592364 | 73892403 | 4300039 | loss | 1415 | PKM2, C15orf59, PPCDC, CELF6, UBL7, HCN4, C15orf39, EDC3, ADPGK, MAN2C1, C15orf34, COX5A, LOXL1, CYP11A1, NPTN, CSK, TBC1D21, | Exon+ve, ≥2 cases | 8.911242604 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| | | | | | | | MIR631, MIR630, COMMD4, GRAMD2, TMEM202, NEO1, CCDC33, PML, SNX33, PARP6, SIN3A, ULK3, SCAMP5, SCAMP2, ARIH1, SENP8, PTPN9, STRA6, THSD4, SNUPN, RPP25, CPLX3, C15orf60, GOLGA6D, GOLGA6C, GOLGA6B, GOLGA6A, NR2E3, MIR4313, C15orf17, DNM1P35, SEMA7A, LOC283731, IMP3, CYP1A1, CYP1A2, ARID3B, ISLR, CSPG4, HEXA, HIGD2B, CD276, BBS4, STOML1, MPI, ODF3L1, NEIL1, MYO9A, LMAN1L, CLK3, ISLR2 | | |
| SEQ ID 143 | 17 | 35072083 | 35073438 | 1355 | loss | 1665 | STARD3 | Exon+ve, ≥2 cases | 7.41506647 |
| SEQ ID 144 | 17 | 35069605 | 35073438 | 3833 | loss | 2045 | STARD3 | Exon+ve, ≥2 cases | 7.41506647 |
| SEQ ID 145 | 9 | 21321182 | 21330461 | 9279 | loss | 1687 | KLHL9 | Exon+ve, ≥2 cases | 7.41506647 |
| SEQ ID 146 | 9 | 21422879 | 21434788 | 11909 | loss | 1777 | IFNA1 | Exon+ve, ≥2 cases | 7.41506647 |
| SEQ ID 147 | 10 | 116949327 | 116971507 | 22180 | gain | 1292 | ATRNL1 | Exon+ve, ≥2 cases | 7.41506647 |
| SEQ ID 147 | 10 | 116949327 | 116971507 | 22180 | gain | 1880 | ATRNL1 | Exon+ve, ≥2 cases | 7.41506647 |
| SEQ ID 148 | 9 | 21245159 | 21274020 | 28861 | gain | 2020 | IFNA22P | Exon+ve, ≥2 cases | 7.41506647 |
| SEQ ID 149 | 10 | 116940096 | 116971507 | 31411 | gain | 1394 | ATRNL1 | Exon+ve, ≥2 cases | 7.41506647 |
| SEQ ID 149 | 10 | 116940096 | 116971507 | 31411 | gain | 1834 | ATRNL1 | Exon+ve, ≥2 cases | 7.41506647 |
| SEQ ID 149 | 10 | 116940096 | 116971507 | 31411 | gain | 1924 | ATRNL1 | Exon+ve, ≥2 cases | 7.41506647 |
| SEQ ID 150 | 4 | 20161068 | 20161847 | 779 | loss | 1426 | SLIT2 | Exon+ve, ≥2 cases | 7.41506647 |
| SEQ ID 150 | 4 | 20161068 | 20161847 | 779 | loss | 1528 | SLIT2 | Exon+ve, ≥2 cases | 7.41506647 |
| SEQ ID 150 | 4 | 20161068 | 20161847 | 779 | loss | 1665 | SLIT2 | Exon+ve, ≥2 cases | 7.41506647 |
| SEQ ID 150 | 4 | 20161068 | 20161847 | 779 | loss | 1667 | SLIT2 | Exon+ve, ≥2 cases | 7.41506647 |
| SEQ ID 151 | 14 | 60551981 | 60553070 | 1089 | loss | 1269 | SLC38A6 | Exon+ve, ≥2 cases | 7.41506647 |
| SEQ ID 151 | 14 | 60551981 | 60553070 | 1089 | gain | 1281 | SLC38A6 | Exon+ve, ≥2 cases | 7.41506647 |
| SEQ ID 151 | 14 | 60551981 | 60553070 | 1089 | gain | 1773 | SLC38A6 | Exon+ve, ≥2 cases | 7.41506647 |
| SEQ ID 152 | X | 15463254 | 15464663 | 1409 | loss | 1234 | BMX | Exon+ve, ≥2 cases | 7.41506647 |
| SEQ ID 152 | X | 15463254 | 15464663 | 1409 | loss | 1320 | BMX | Exon+ve, ≥2 cases | 7.41506647 |
| SEQ ID 152 | X | 15463254 | 15464663 | 1409 | loss | 1822 | BMX | Exon+ve, ≥2 cases | 7.41506647 |
| SEQ ID 152 | X | 15463254 | 15464663 | 1409 | loss | 1827 | BMX | Exon+ve, ≥2 cases | 7.41506647 |
| SEQ ID 152 | X | 15463254 | 15464663 | 1409 | loss | 1876 | BMX | Exon+ve, ≥2 cases | 7.41506647 |
| SEQ ID 153 | 21 | 27260832 | 27262559 | 1727 | loss | 1442 | ADAMTS5 | Exon+ve, ≥2 cases | 7.41506647 |
| SEQ ID 153 | 21 | 27260832 | 27262559 | 1727 | loss | 1522 | ADAMTS5 | Exon+ve, ≥2 cases | 7.41506647 |
| SEQ ID 153 | 21 | 27260832 | 27262559 | 1727 | loss | 1714 | ADAMTS5 | Exon+ve, ≥2 cases | 7.41506647 |
| SEQ ID 153 | 21 | 27260832 | 27262559 | 1727 | loss | 1828 | ADAMTS5 | Exon+ve, ≥2 cases | 7.41506647 |
| SEQ ID 153 | 21 | 27260832 | 27262559 | 1727 | loss | 1915 | ADAMTS5 | Exon+ve, ≥2 cases | 7.41506647 |
| SEQ ID 154 | 19 | 15420954 | 15422784 | 1830 | loss | 1471 | MIR1470, WIZ | Exon+ve, ≥2 cases | 7.41506647 |
| SEQ ID 154 | 19 | 15420954 | 15422784 | 1830 | loss | 1687 | MIR1470, WIZ | Exon+ve, ≥2 cases | 7.41506647 |
| SEQ ID 154 | 19 | 15420954 | 15422784 | 1830 | loss | 1887 | MIR1470, WIZ | Exon+ve, ≥2 cases | 7.41506647 |
| SEQ ID 155 | 19 | 15420382 | 15422978 | 2596 | loss | 1676 | MIR1470, WIZ | Exon+ve, ≥2 cases | 7.41506647 |
| SEQ ID 156 | 10 | 5985730 | 5988631 | 2901 | loss | 2024 | FBXO18 | Exon+ve, ≥2 cases | 7.41506647 |
| SEQ ID 157 | 6 | 159234892 | 159238587 | 3695 | loss | 1419 | C6orf99 | Exon+ve, ≥2 cases | 7.41506647 |
| SEQ ID 144 | 17 | 35069605 | 35073438 | 3833 | loss | 1316 | STARD3 | Exon+ve, ≥2 cases | 7.41506647 |
| SEQ ID 144 | 17 | 35069605 | 35073438 | 3833 | loss | 1318 | STARD3 | Exon+ve, ≥2 cases | 7.41506647 |
| SEQ ID 144 | 17 | 35069605 | 35073438 | 3833 | loss | 1676 | STARD3 | Exon+ve, ≥2 cases | 7.41506647 |
| SEQ ID 158 | 4 | 20157798 | 20161847 | 4049 | loss | 1671 | SLIT2 | Exon+ve, ≥2 cases | 7.41506647 |
| SEQ ID 159 | 19 | 15418682 | 15422978 | 4296 | loss | 1726 | MIR1470, WIZ | Exon+ve, ≥2 cases | 7.41506647 |
| SEQ ID 160 | 2 | 206586117 | 206590636 | 4519 | gain | 1220 | INO80D | Exon+ve, ≥2 cases | 7.41506647 |
| SEQ ID 161 | 9 | 132916080 | 132921442 | 5362 | loss | 1897 | LAMC3 | Exon+ve, ≥2 cases | 7.41506647 |
| SEQ ID 162 | 6 | 105298061 | 105303833 | 5772 | loss | 1426 | HACE1 | Exon+ve, ≥2 cases | 7.41506647 |
| SEQ ID 162 | 6 | 105298061 | 105303833 | 5772 | loss | 1458 | HACE1 | Exon+ve, ≥2 cases | 7.41506647 |
| SEQ ID 162 | 6 | 105298061 | 105303833 | 5772 | loss | 1490 | HACE1 | Exon+ve, ≥2 cases | 7.41506647 |
| SEQ ID 162 | 6 | 105298061 | 105303833 | 5772 | loss | 1492 | HACE1 | Exon+ve, ≥2 cases | 7.41506647 |
| SEQ ID 163 | 2 | 206586117 | 206592116 | 5999 | gain | 1803 | INO80D | Exon+ve, ≥2 cases | 7.41506647 |
| SEQ ID 163 | 2 | 206586117 | 206592116 | 5999 | gain | 1988 | INO80D | Exon+ve, ≥2 cases | 7.41506647 |
| SEQ ID 163 | 2 | 206586117 | 206592116 | 5999 | gain | 2028 | INO80D | Exon+ve, ≥2 cases | 7.41506647 |
| SEQ ID 164 | 19 | 56882602 | 56889437 | 6835 | loss | 1965 | MIR99B, MIRLET7E, MIR125A, NCRNA00085 | Exon+ve, ≥2 cases | 7.41506647 |
| SEQ ID 164 | 19 | 56882602 | 56889437 | 6835 | loss | 2032 | MIR99B, MIRLET7E, MIR125A, NCRNA00085 | Exon+ve, ≥2 cases | 7.41506647 |
| SEQ ID 165 | 3 | 64479002 | 64486008 | 7006 | loss | 1428 | ADAMTS9 | Exon+ve, ≥2 cases | 7.41506647 |
| SEQ ID 165 | 3 | 64479002 | 64486008 | 7006 | loss | 1434 | ADAMTS9 | Exon+ve, ≥2 cases | 7.41506647 |
| SEQ ID 165 | 3 | 64479002 | 64486008 | 7006 | loss | 1572 | ADAMTS9 | Exon+ve, ≥2 cases | 7.41506647 |
| SEQ ID 165 | 3 | 64479002 | 64486008 | 7006 | loss | 1592 | ADAMTS9 | Exon+ve, ≥2 cases | 7.41506647 |
| SEQ ID 165 | 3 | 64479002 | 64486008 | 7006 | loss | 1763 | ADAMTS9 | Exon+ve, ≥2 cases | 7.41506647 |
| SEQ ID 166 | 2 | 135704927 | 135712021 | 7094 | loss | 1512 | ZRANB3 | Exon+ve, ≥2 cases | 7.41506647 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 166 | 2 | 135704927 | 135712021 | 7094 | loss | 1574 | ZRANB3 | Exon+ve, ≥2 cases | 7.41506647 |
| SEQ ID 166 | 2 | 135704927 | 135712021 | 7094 | loss | 1757 | ZRANB3 | Exon+ve, ≥2 cases | 7.41506647 |
| SEQ ID 166 | 2 | 135704927 | 135712021 | 7094 | gain | 1970 | ZRANB3 | Exon+ve, ≥2 cases | 7.41506647 |
| SEQ ID 167 | 19 | 56881984 | 56889437 | 7453 | loss | 1859 | MIR99B, MIRLET7E, MIR125A, NCRNA00085 | Exon+ve, ≥2 cases | 7.41506647 |
| SEQ ID 168 | 4 | 74504402 | 74511880 | 7478 | loss | 1373 | ALB | Exon+ve, ≥2 cases | 7.41506647 |
| SEQ ID 168 | 4 | 74504402 | 74511880 | 7478 | loss | 1464 | ALB | Exon+ve, ≥2 cases | 7.41506647 |
| SEQ ID 168 | 4 | 74504402 | 74511880 | 7478 | loss | 1798 | ALB | Exon+ve, ≥2 cases | 7.41506647 |
| SEQ ID 168 | 4 | 74504402 | 74511880 | 7478 | loss | 1959 | ALB | Exon+ve, ≥2 cases | 7.41506647 |
| SEQ ID 169 | 9 | 19775974 | 19783547 | 7573 | loss | 1511 | SLC24A2 | Exon+ve, ≥2 cases | 7.41506647 |
| SEQ ID 170 | 2 | 206584487 | 206592116 | 7629 | gain | 1921 | INO80D | Exon+ve, ≥2 cases | 7.41506647 |
| SEQ ID 171 | 10 | 5985730 | 5993423 | 7693 | loss | 1307 | FBXO18 | Exon+ve, ≥2 cases | 7.41506647 |
| SEQ ID 171 | 10 | 5985730 | 5993423 | 7693 | loss | 1409 | FBXO18 | Exon+ve, ≥2 cases | 7.41506647 |
| SEQ ID 171 | 10 | 5985730 | 5993423 | 7693 | loss | 1619 | FBXO18 | Exon+ve, ≥2 cases | 7.41506647 |
| SEQ ID 172 | 14 | 60544757 | 60553070 | 8313 | loss | 1470 | SLC38A6 | Exon+ve, ≥2 cases | 7.41506647 |
| SEQ ID 172 | 14 | 60544757 | 60553070 | 8313 | loss | 2000 | SLC38A6 | Exon+ve, ≥2 cases | 7.41506647 |
| SEQ ID 173 | 2 | 135704927 | 135713556 | 8629 | gain | 1451 | ZRANB3 | Exon+ve, ≥2 cases | 7.41506647 |
| SEQ ID 174 | 19 | 56880318 | 56889437 | 9119 | loss | 1232 | MIR99B, MIRLET7E, MIR125A, NCRNA00085 | Exon+ve, ≥2 cases | 7.41506647 |
| SEQ ID 175 | 10 | 5984217 | 5993423 | 9206 | loss | 1654 | FBXO18 | Exon+ve, ≥2 cases | 7.41506647 |
| SEQ ID 176 | 9 | 132912215 | 132921442 | 9227 | loss | 1345 | LAMC3 | Exon+ve, ≥2 cases | 7.41506647 |
| SEQ ID 177 | 6 | 159234892 | 159244475 | 9583 | loss | 1742 | C6orf99 | Exon+ve, ≥2 cases | 7.41506647 |
| SEQ ID 177 | 6 | 159234892 | 159244475 | 9583 | loss | 1900 | C6orf99 | Exon+ve, ≥2 cases | 7.41506647 |
| SEQ ID 178 | 9 | 132910836 | 132921442 | 10606 | loss | 1621 | LAMC3 | Exon+ve, ≥2 cases | 7.41506647 |
| SEQ ID 178 | 9 | 132910836 | 132921442 | 10606 | loss | 1639 | LAMC3 | Exon+ve, ≥2 cases | 7.41506647 |
| SEQ ID 179 | 4 | 74504402 | 74515385 | 10983 | loss | 1852 | ALB | Exon+ve, ≥2 cases | 7.41506647 |
| SEQ ID 180 | 9 | 132907202 | 132921442 | 14240 | loss | 1720 | LAMC3 | Exon+ve, ≥2 cases | 7.41506647 |
| SEQ ID 181 | 19 | 56880318 | 56895839 | 15521 | loss | 1993 | MIR99B, MIRLET7E, MIR125A, NCRNA00085 | Exon+ve, ≥2 cases | 7.41506647 |
| SEQ ID 182 | 6 | 159184210 | 159203355 | 19145 | loss | 1582 | OSTCL | Exon+ve, ≥2 cases | 7.41506647 |
| SEQ ID 183 | 6 | 105291227 | 105311034 | 19807 | loss | 1500 | HACE1 | Exon+ve, ≥2 cases | 7.41506647 |
| SEQ ID 184 | 7 | 153742206 | 153792779 | 50573 | loss | 1885 | DPP6 | Exon+ve, ≥2 cases | 7.41506647 |
| SEQ ID 185 | 6 | 159190838 | 159251696 | 60858 | loss | 1468 | OSTCL, C6orf99 | Exon+ve, ≥2 cases | 7.41506647 |
| SEQ ID 186 | 7 | 153775546 | 153845854 | 70308 | loss | 1949 | DPP6 | Exon+ve, ≥2 cases | 7.41506647 |
| SEQ ID 187 | 7 | 153134693 | 153290833 | 156140 | gain | 1486 | DPP6 | Exon+ve, ≥2 cases | 7.41506647 |
| SEQ ID 188 | 7 | 153158956 | 153384745 | 225789 | gain | 1755 | DPP6 | Exon+ve, ≥2 cases | 7.41506647 |
| SEQ ID 189 | 7 | 152883490 | 154689863 | 1806373 | gain | 1730 | HTR5A, LOC100132707, LOC202781, DPP6, PAXIP1 | Exon+ve, ≥2 cases | 7.41506647 |
| SEQ ID 190 | 9 | 19677387 | 24675102 | 4997715 | loss | 1418 | MIR31, ELAVL2, PTPLAD2, CDKN2B-AS1, MIR491, MLLT3, IFNW1, IFNB1, C9orf53, IFNA22P, IFNA13, IFNA10, IFNA17, IFNA16, IFNA14, CDKN2B, CDKN2A, IFNE, SLC24A2, KIAA1797, MTAP, KLHL9, IFNA8, IFNA2, IFNA1, DMRTA1, IFNA7, IFNA6, IFNA5, IFNA4, IFNA21, LOC554202 | Exon+ve, ≥2 cases | 7.41506647 |
| SEQ ID 191 | 6 | 160246670 | 160248266 | 1596 | gain | 1870 | MAS1 | Exon+ve, ≥2 cases | 5.923303835 |
| SEQ ID 192 | 14 | 70273290 | 70276007 | 2717 | loss | 2002 | MAP3K9 | Exon+ve, ≥2 cases | 5.923303835 |
| SEQ ID 193 | 19 | 11448975 | 11452390 | 3415 | gain | 1864 | ELAVL3 | Exon+ve, ≥2 cases | 5.923303835 |
| SEQ ID 194 | 2 | 218849164 | 218852974 | 3810 | gain | 2024 | PNKD, TMBIM1 | Exon+ve, ≥2 cases | 5.923303835 |
| SEQ ID 195 | 15 | 42365660 | 42371493 | 5833 | loss | 1662 | CASC4 | Exon+ve, ≥2 cases | 5.923303835 |
| SEQ ID 196 | 14 | 102447536 | 102455572 | 8036 | loss | 1800 | TRAF3 | Exon+ve, ≥2 cases | 5.923303835 |
| SEQ ID 197 | 10 | 55580662 | 55589321 | 8659 | loss | 1475 | PCDH15 | Exon+ve, ≥2 cases | 5.923303835 |
| SEQ ID 197 | 10 | 55580662 | 55589321 | 8659 | loss | 1537 | PCDH15 | Exon+ve, ≥2 cases | 5.923303835 |
| SEQ ID 198 | 8 | 22631429 | 22641498 | 10069 | loss | 1849 | PEBP4 | Exon+ve, ≥2 cases | 5.923303835 |
| SEQ ID 199 | 10 | 55328218 | 55339243 | 11025 | gain | 1309 | PCDH15 | Exon+ve, ≥2 cases | 5.923303835 |
| SEQ ID 200 | 6 | 134622620 | 134635779 | 13159 | loss | 1708 | SGK1 | Exon+ve, ≥2 cases | 5.923303835 |
| SEQ ID 201 | 7 | 45079997 | 45096030 | 16033 | loss | 1907 | NACAD, CCM2 | Exon+ve, ≥2 cases | 5.923303835 |
| SEQ ID 202 | 17 | 18814921 | 18869072 | 54151 | gain | 1717 | GRAP, SLC5A10, FAM83G | Exon+ve, ≥2 cases | 5.923303835 |
| SEQ ID 203 | 13 | 22317487 | 22381531 | 64044 | gain | 1919 | BASP1P1 | Exon+ve, ≥2 cases | 5.923303835 |
| SEQ ID 204 | 8 | 43057445 | 43647063 | 589618 | gain | 1695 | HGSNAT, FNTA, POTEA, SGK196 | Exon+ve, ≥2 cases | 5.923303835 |
| SEQ ID 205 | 12 | 20859893 | 20860186 | 293 | loss | 1225 | SLCO1B3 | Exon+ve, ≥2 cases | 5.923303835 |
| SEQ ID 205 | 12 | 20859893 | 20860186 | 293 | loss | 1577 | SLCO1B3 | Exon+ve, ≥2 cases | 5.923303835 |
| SEQ ID 205 | 12 | 20859893 | 20860186 | 293 | loss | 1581 | SLCO1B3 | Exon+ve, ≥2 cases | 5.923303835 |
| SEQ ID 206 | 1 | 91632025 | 91632374 | 349 | loss | 1582 | HFM1 | Exon+ve, ≥2 cases | 5.923303835 |
| SEQ ID 206 | 1 | 91632025 | 91632374 | 349 | loss | 1687 | HFM1 | Exon+ve, ≥2 cases | 5.923303835 |
| SEQ ID 206 | 1 | 91632025 | 91632374 | 349 | loss | 1929 | HFM1 | Exon+ve, ≥2 cases | 5.923303835 |
| SEQ ID 206 | 1 | 91632025 | 91632374 | 349 | loss | 2045 | HFM1 | Exon+ve, ≥2 cases | 5.923303835 |
| SEQ ID 207 | 6 | 160247865 | 160248266 | 401 | gain | 1242 | MAS1 | Exon+ve, ≥2 cases | 5.923303835 |
| SEQ ID 208 | 1 | 94115122 | 94116506 | 1384 | loss | 1782 | DNTTIP2 | Exon+ve, ≥2 cases | 5.923303835 |
| SEQ ID 209 | 14 | 70274601 | 70276007 | 1406 | loss | 1910 | MAP3K9 | Exon+ve, ≥2 cases | 5.923303835 |
| SEQ ID 209 | 14 | 70274601 | 70276007 | 1406 | loss | 2001 | MAP3K9 | Exon+ve, ≥2 cases | 5.923303835 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 210 | 2 | 201713188 | 201714627 | 1439 | gain | 1344 | CFLAR | Exon+ve, ≥2 cases | 5.923303835 |
| SEQ ID 210 | 2 | 201713188 | 201714627 | 1439 | gain | 1824 | CFLAR | Exon+ve, ≥2 cases | 5.923303835 |
| SEQ ID 210 | 2 | 201713188 | 201714627 | 1439 | gain | 1841 | CFLAR | Exon+ve, ≥2 cases | 5.923303835 |
| SEQ ID 210 | 2 | 201713188 | 201714627 | 1439 | gain | 1927 | CFLAR | Exon+ve, ≥2 cases | 5.923303835 |
| SEQ ID 211 | 19 | 11450908 | 11452390 | 1482 | gain | 1637 | ELAVL3 | Exon+ve, ≥2 cases | 5.923303835 |
| SEQ ID 212 | 1 | 3752549 | 3754045 | 1496 | loss | 1426 | KIAA0562 | Exon+ve, ≥2 cases | 5.923303835 |
| SEQ ID 212 | 1 | 3752549 | 3754045 | 1496 | loss | 1439 | KIAA0562 | Exon+ve, ≥2 cases | 5.923303835 |
| SEQ ID 212 | 1 | 3752549 | 3754045 | 1496 | loss | 1441 | KIAA0562 | Exon+ve, ≥2 cases | 5.923303835 |
| SEQ ID 212 | 1 | 3752549 | 3754045 | 1496 | loss | 1912 | KIAA0562 | Exon+ve, ≥2 cases | 5.923303835 |
| SEQ ID 191 | 6 | 160246670 | 160248266 | 1596 | gain | 1571 | MAS1 | Exon+ve, ≥2 cases | 5.923303835 |
| SEQ ID 213 | 12 | 20858372 | 20860186 | 1814 | loss | 1488 | SLCO1B3 | Exon+ve, ≥2 cases | 5.923303835 |
| SEQ ID 214 | 1 | 94113132 | 94115122 | 1990 | loss | 1904 | DNTTIP2 | Exon+ve, ≥2 cases | 5.923303835 |
| SEQ ID 215 | 7 | 147734925 | 147737360 | 2435 | loss | 1346 | CNTNAP2 | Exon+ve, ≥2 cases | 5.923303835 |
| SEQ ID 215 | 7 | 147734925 | 147737360 | 2435 | loss | 1403 | CNTNAP2 | Exon+ve, ≥2 cases | 5.923303835 |
| SEQ ID 215 | 7 | 147734925 | 147737360 | 2435 | loss | 1988 | CNTNAP2 | Exon+ve, ≥2 cases | 5.923303835 |
| SEQ ID 216 | 15 | 93669003 | 93671527 | 2524 | gain | 1309 | LOC400456 | Exon+ve, ≥2 cases | 5.923303835 |
| SEQ ID 216 | 15 | 93669003 | 93671527 | 2524 | gain | 1825 | LOC400456 | Exon+ve, ≥2 cases | 5.923303835 |
| SEQ ID 216 | 15 | 93669003 | 93671527 | 2524 | gain | 1837 | LOC400456 | Exon+ve, ≥2 cases | 5.923303835 |
| SEQ ID 217 | 9 | 15655922 | 15658483 | 2561 | loss | 1386 | C9orf93 | Exon+ve, ≥2 cases | 5.923303835 |
| SEQ ID 217 | 9 | 15655922 | 15658483 | 2561 | loss | 1477 | C9orf93 | Exon+ve, ≥2 cases | 5.923303835 |
| SEQ ID 217 | 9 | 15655922 | 15658483 | 2561 | loss | 1594 | C9orf93 | Exon+ve, ≥2 cases | 5.923303835 |
| SEQ ID 217 | 9 | 15655922 | 15658483 | 2561 | loss | 1881 | C9orf93 | Exon+ve, ≥2 cases | 5.923303835 |
| SEQ ID 192 | 14 | 70273290 | 70276007 | 2717 | loss | 1314 | MAP3K9 | Exon+ve, ≥2 cases | 5.923303835 |
| SEQ ID 218 | 1 | 94113132 | 94116506 | 3374 | loss | 1802 | DNTTIP2 | Exon+ve, ≥2 cases | 5.923303835 |
| SEQ ID 193 | 19 | 11448975 | 11452390 | 3415 | gain | 1780 | ELAVL3 | Exon+ve, ≥2 cases | 5.923303835 |
| SEQ ID 193 | 19 | 11448975 | 11452390 | 3415 | gain | 1788 | ELAVL3 | Exon+ve, ≥2 cases | 5.923303835 |
| SEQ ID 219 | 2 | 218971708 | 218975318 | 3610 | loss | 1913 | CTDSP1 | Exon+ve, ≥2 cases | 5.923303835 |
| SEQ ID 194 | 2 | 218849164 | 218852974 | 3810 | gain | 1284 | PNKD, TMBIM1 | Exon+ve, ≥2 cases | 5.923303835 |
| SEQ ID 194 | 2 | 218849164 | 218852974 | 3810 | gain | 1728 | PNKD, TMBIM1 | Exon+ve, ≥2 cases | 5.923303835 |
| SEQ ID 220 | 2 | 214582921 | 214586936 | 4015 | loss | 1512 | SPAG16 | Exon+ve, ≥2 cases | 5.923303835 |
| SEQ ID 221 | 6 | 29653815 | 29658113 | 4298 | loss | 1275 | SNORD32B | Exon+ve, ≥2 cases | 5.923303835 |
| SEQ ID 221 | 6 | 29653815 | 29658113 | 4298 | loss | 1862 | SNORD32B | Exon+ve, ≥2 cases | 5.923303835 |
| SEQ ID 222 | 1 | 94113132 | 94117960 | 4828 | loss | 1233 | DNTTIP2 | Exon+ve, ≥2 cases | 5.923303835 |
| SEQ ID 223 | 2 | 218972428 | 218978243 | 5815 | loss | 1718 | MIR26B, CTDSP1 | Exon+ve, ≥2 cases | 5.923303835 |
| SEQ ID 224 | 6 | 29653815 | 29659892 | 6077 | loss | 1440 | SNORD32B | Exon+ve, ≥2 cases | 5.923303835 |
| SEQ ID 224 | 6 | 29653815 | 29659892 | 6077 | loss | 1750 | SNORD32B | Exon+ve, ≥2 cases | 5.923303835 |
| SEQ ID 225 | 8 | 43288182 | 43294454 | 6272 | loss | 1549 | POTEA | Exon+ve, ≥2 cases | 5.923303835 |
| SEQ ID 226 | 17 | 57329783 | 57336509 | 6726 | loss | 1784 | INTS2 | Exon+ve, ≥2 cases | 5.923303835 |
| SEQ ID 227 | 19 | 53896677 | 53903470 | 6793 | loss | 1227 | FUT2 | Exon+ve, ≥2 cases | 5.923303835 |
| SEQ ID 227 | 19 | 53896677 | 53903470 | 6793 | loss | 1448 | FUT2 | Exon+ve, ≥2 cases | 5.923303835 |
| SEQ ID 228 | 2 | 218844854 | 218852974 | 8120 | gain | 1660 | PNKD, TMBIM1 | Exon+ve, ≥2 cases | 5.923303835 |
| SEQ ID 229 | 14 | 102447174 | 102455572 | 8398 | loss | 1820 | TRAF3 | Exon+ve, ≥2 cases | 5.923303835 |
| SEQ ID 230 | 14 | 102401445 | 102409996 | 8551 | gain | 1838 | TRAF3 | Exon+ve, ≥2 cases | 5.923303835 |
| SEQ ID 231 | 17 | 57327446 | 57336509 | 9063 | loss | 1439 | INTS2 | Exon+ve, ≥2 cases | 5.923303835 |
| SEQ ID 231 | 17 | 57327446 | 57336509 | 9063 | loss | 1601 | INTS2 | Exon+ve, ≥2 cases | 5.923303835 |
| SEQ ID 232 | 19 | 53892641 | 53901719 | 9078 | loss | 1697 | FUT2 | Exon+ve, ≥2 cases | 5.923303835 |
| SEQ ID 233 | 17 | 57327446 | 57336828 | 9382 | loss | 1641 | INTS2 | Exon+ve, ≥2 cases | 5.923303835 |
| SEQ ID 234 | 1 | 226061846 | 226072012 | 10166 | loss | 1371 | PRSS38 | Exon+ve, ≥2 cases | 5.923303835 |
| SEQ ID 234 | 1 | 226061846 | 226072012 | 10166 | loss | 1653 | PRSS38 | Exon+ve, ≥2 cases | 5.923303835 |
| SEQ ID 235 | 19 | 53891467 | 53901719 | 10252 | loss | 1694 | FUT2 | Exon+ve, ≥2 cases | 5.923303835 |
| SEQ ID 236 | X | 8463131 | 8473482 | 10351 | loss | 1298 | KAL1 | Exon+ve, ≥2 cases | 5.923303835 |
| SEQ ID 236 | X | 8463131 | 8473482 | 10351 | loss | 1432 | KAL1 | Exon+ve, ≥2 cases | 5.923303835 |
| SEQ ID 237 | 2 | 218967950 | 218978839 | 10889 | loss | 1721 | MIR26B, CTDSP1, SLC11A1 | Exon+ve, ≥2 cases | 5.923303835 |
| SEQ ID 237 | 2 | 218967950 | 218978839 | 10889 | loss | 1993 | MIR26B, CTDSP1, SLC11A1 | Exon+ve, ≥2 cases | 5.923303835 |
| SEQ ID 238 | 6 | 134624093 | 134635779 | 11686 | loss | 1576 | SGK1 | Exon+ve, ≥2 cases | 5.923303835 |
| SEQ ID 238 | 6 | 134624093 | 134635779 | 11686 | loss | 1667 | SGK1 | Exon+ve, ≥2 cases | 5.923303835 |
| SEQ ID 239 | 8 | 22629771 | 22641498 | 11727 | loss | 1293 | PEBP4 | Exon+ve, ≥2 cases | 5.923303835 |
| SEQ ID 239 | 8 | 22629771 | 22641498 | 11727 | loss | 1296 | PEBP4 | Exon+ve, ≥2 cases | 5.923303835 |
| SEQ ID 239 | 8 | 22629771 | 22641498 | 11727 | loss | 1842 | PEBP4 | Exon+ve, ≥2 cases | 5.923303835 |
| SEQ ID 200 | 6 | 134622620 | 134635779 | 13159 | loss | 1224 | SGK1 | Exon+ve, ≥2 cases | 5.923303835 |
| SEQ ID 240 | 1 | 179250547 | 179263983 | 13436 | loss | 1950 | STX6 | Exon+ve, ≥2 cases | 5.923303835 |
| SEQ ID 241 | 1 | 226061846 | 226075375 | 13529 | loss | 1234 | PRSS38 | Exon+ve, ≥2 cases | 5.923303835 |
| SEQ ID 242 | 15 | 42357661 | 42371493 | 13832 | loss | 1659 | CASC4 | Exon+ve, ≥2 cases | 5.923303835 |
| SEQ ID 243 | 2 | 213922938 | 213938010 | 15072 | loss | 1870 | SPAG16 | Exon+ve, distinct CNVs, same Gene | 5.923303835 |
| SEQ ID 244 | 1 | 179248755 | 179263983 | 15228 | loss | 1662 | STX6 | Exon+ve, ≥2 cases | 5.923303835 |
| SEQ ID 201 | 7 | 45079997 | 45096030 | 16033 | loss | 1642 | NACAD, CCM2 | Exon+ve, ≥2 cases | 5.923303835 |
| SEQ ID 201 | 7 | 45079997 | 45096030 | 16033 | loss | 1819 | NACAD, CCM2 | Exon+ve, ≥2 cases | 5.923303835 |
| SEQ ID 201 | 7 | 45079997 | 45096030 | 16033 | loss | 1825 | NACAD, CCM2 | Exon+ve, ≥2 cases | 5.923303835 |
| SEQ ID 245 | 2 | 214582921 | 214599105 | 16184 | loss | 1636 | SPAG16 | Exon+ve, ≥2 cases | 5.923303835 |
| SEQ ID 246 | 1 | 179250547 | 179269450 | 18903 | loss | 1638 | MR1, STX6 | Exon+ve, ≥2 cases | 5.923303835 |
| SEQ ID 247 | 15 | 42356510 | 42378169 | 21659 | loss | 1638 | CASC4 | Exon+ve, ≥2 cases | 5.923303835 |
| SEQ ID 248 | 2 | 213900382 | 213922938 | 22556 | loss | 1832 | SPAG16 | Exon+ve, distinct CNVs, same Gene | 5.923303835 |
| SEQ ID 249 | 1 | 179250547 | 179274160 | 23613 | loss | 1659 | MR1, STX6 | Exon+ve, ≥2 cases | 5.923303835 |
| SEQ ID 250 | 15 | 93669003 | 93697249 | 28246 | gain | 1841 | LOC400456 | Exon+ve, ≥2 cases | 5.923303835 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 251 | 1 | 226061846 | 226091036 | 29190 | loss | 1344 | PRSS38 | Exon+ve, ≥2 cases | 5.923303835 |
| SEQ ID 252 | 15 | 42354464 | 42395549 | 41085 | loss | 1660 | CASC4 | Exon+ve, ≥2 cases | 5.923303835 |
| SEQ ID 253 | 11 | 5848930 | 5892024 | 43094 | gain | 1593 | OR52E4 | Exon+ve, ≥2 cases | 5.923303835 |
| SEQ ID 253 | 11 | 5848930 | 5892024 | 43094 | gain | 1920 | OR52E4 | Exon+ve, ≥2 cases | 5.923303835 |
| SEQ ID 254 | 11 | 5839924 | 5892024 | 52100 | gain | 1333 | OR52E4 | Exon+ve, ≥2 cases | 5.923303835 |
| SEQ ID 255 | 11 | 5848930 | 5902760 | 53830 | gain | 1301 | OR52E4 | Exon+ve, ≥2 cases | 5.923303835 |
| SEQ ID 203 | 13 | 22317487 | 22381531 | 64044 | loss | 1714 | BASP1P1 | Exon+ve, ≥2 cases | 5.923303835 |
| SEQ ID 256 | 17 | 18769179 | 18864625 | 95446 | loss | 1596 | SLC5A10, FAM83G, PRPSAP2 | Exon+ve, ≥2 cases | 5.923303835 |
| SEQ ID 257 | 6 | 160237631 | 160371016 | 133385 | gain | 1574 | IGF2R, MAS1 | Exon+ve, ≥2 cases | 5.923303835 |
| SEQ ID 258 | 13 | 22250683 | 22404389 | 153706 | gain | 1662 | BASP1P1 | Exon+ve, ≥2 cases | 5.923303835 |
| SEQ ID 259 | X | 8397974 | 8677639 | 279665 | gain | 1566 | KAL1 | Exon+ve, ≥2 cases | 5.923303835 |
| SEQ ID 260 | 13 | 22140379 | 22523807 | 383428 | gain | 1744 | BASP1P1 | Exon+ve, ≥2 cases | 5.923303835 |
| SEQ ID 261 | X | 8397974 | 8790795 | 392821 | gain | 1901 | KAL1, FAM9A | Exon+ve, ≥2 cases | 5.923303835 |
| SEQ ID 262 | 8 | 43170238 | 43647063 | 476825 | gain | 1316 | HGSNAT, POTEA | Exon+ve, ≥2 cases | 5.923303835 |
| SEQ ID 204 | 8 | 43057445 | 43647063 | 589618 | gain | 1406 | HGSNAT, FNTA, POTEA, SGK196 | Exon+ve, ≥2 cases | 5.923303835 |
| SEQ ID 263 | 10 | 55202411 | 57178733 | 1976322 | gain | 1429 | MTRNR2L5, PCDH15 | Exon+ve, ≥2 cases | 5.923303835 |
| SEQ ID 264 | 14 | 102008576 | 105330913 | 3322337 | gain | 1447 | BAG5, SNORA28, TRMT61A, EIF5, MIR4309, RCOR1, EXOC3L4, TMEM179, XRCC3, LOC100131366, INF2, ASPG, AMN, CKB, SIVA1, ANKRD9, MIR203, CDC42BPB, MARK3, JAG2, C14orf153, LOC647310, MTA1, TDRD9, TRAF3, TMEM121, CDCA4, TECPR2, KIF26A, NUDT14, AHNAK2, MGC23270, ADSSL1, BRF1, C14orf180, PACS2, C14orf79, PLD4, ZFYVE21, AKT1, C14orf80, KIAA0284, TNFAIP2, ZBTB42, PPP1R13B, GPR132, C14orf2, KLC1, BTBD6, CRIP1, CRIP2 | Exon+ve, ≥2 cases | 5.923303835 |
| SEQ ID 265 | 2 | 1469952 | 1472562 | 2610 | loss | 1564 | TPO | Exon+ve, ≥2 cases | 4.435935199 |
| SEQ ID 265 | 2 | 1469952 | 1472562 | 2610 | loss | 1639 | TPO | Exon+ve, ≥2 cases | 4.435935199 |
| SEQ ID 266 | X | 70057266 | 70062203 | 4937 | gain | 1346 | SLC7A3 | Exon+ve, ≥2 cases | 4.435935199 |
| SEQ ID 267 | 16 | 48955985 | 48960972 | 4987 | loss | 1395 | BRD7 | Exon+ve, ≥2 cases | 4.435935199 |
| SEQ ID 267 | 16 | 48955985 | 48960972 | 4987 | loss | 1409 | BRD7 | Exon+ve, ≥2 cases | 4.435935199 |
| SEQ ID 267 | 16 | 48955985 | 48960972 | 4987 | loss | 1428 | BRD7 | Exon+ve, ≥2 cases | 4.435935199 |
| SEQ ID 268 | 19 | 62343981 | 62349061 | 5080 | loss | 1995 | ZIM3 | Exon+ve, ≥2 cases | 4.435935199 |
| SEQ ID 268 | 19 | 62343981 | 62349061 | 5080 | loss | 1996 | ZIM3 | Exon+ve, ≥2 cases | 4.435935199 |
| SEQ ID 269 | X | 46832380 | 46837814 | 5434 | loss | 1675 | RGN | Exon+ve, ≥2 cases | 4.435935199 |
| SEQ ID 269 | X | 46832380 | 46837814 | 5434 | gain | 1896 | RGN | Exon+ve, ≥2 cases | 4.435935199 |
| SEQ ID 269 | X | 46832380 | 46837814 | 5434 | gain | 2040 | RGN | Exon+ve, ≥2 cases | 4.435935199 |
| SEQ ID 270 | X | 128775325 | 128780946 | 5621 | gain | 1459 | ZDHHC9 | Exon+ve, ≥2 cases | 4.435935199 |
| SEQ ID 271 | X | 123691710 | 123698719 | 7009 | loss | 1421 | ODZ1 | Exon+ve, ≥2 cases | 4.435935199 |
| SEQ ID 271 | X | 123691710 | 123698719 | 7009 | loss | 1428 | ODZ1 | Exon+ve, ≥2 cases | 4.435935199 |
| SEQ ID 271 | X | 123691710 | 123698719 | 7009 | loss | 1805 | ODZ1 | Exon+ve, ≥2 cases | 4.435935199 |
| SEQ ID 272 | X | 100665462 | 100673058 | 7596 | gain | 1269 | ARMCX4 | Exon+ve, ≥2 cases | 4.435935199 |
| SEQ ID 272 | X | 100665462 | 100673058 | 7596 | gain | 1857 | ARMCX4 | Exon+ve, ≥2 cases | 4.435935199 |
| SEQ ID 273 | 19 | 53590042 | 53598814 | 8772 | loss | 1901 | GRIN2D | Exon+ve, ≥2 cases | 4.435935199 |
| SEQ ID 273 | 19 | 53590042 | 53598814 | 8772 | loss | 1959 | GRIN2D | Exon+ve, ≥2 cases | 4.435935199 |
| SEQ ID 274 | X | 128772381 | 128782290 | 9909 | gain | 1824 | ZDHHC9 | Exon+ve, ≥2 cases | 4.435935199 |
| SEQ ID 275 | X | 70051128 | 70062203 | 11075 | gain | 1308 | SLC7A3 | Exon+ve, ≥2 cases | 4.435935199 |
| SEQ ID 276 | X | 70049036 | 70062203 | 13167 | gain | 1284 | SLC7A3 | Exon+ve, ≥2 cases | 4.435935199 |
| SEQ ID 277 | 19 | 53585489 | 53598814 | 13325 | loss | 1671 | KDELR1, GRIN2D | Exon+ve, ≥2 cases | 4.435935199 |
| SEQ ID 278 | X | 128768758 | 128782290 | 13532 | gain | 1806 | ZDHHC9 | Exon+ve, ≥2 cases | 4.435935199 |
| SEQ ID 279 | X | 100658130 | 100673058 | 14928 | loss | 1413 | ARMCX4 | Exon+ve, ≥2 cases | 4.435935199 |
| SEQ ID 280 | 19 | 23786448 | 23804481 | 18033 | gain | 1541 | RPSAP58 | Exon+ve, ≥2 cases | 4.435935199 |
| SEQ ID 280 | 19 | 23786448 | 23804481 | 18033 | gain | 1608 | RPSAP58 | Exon+ve, ≥2 cases | 4.435935199 |
| SEQ ID 281 | 22 | 16661122 | 16680825 | 19703 | loss | 1805 | MICAL3 | Exon+ve, ≥2 cases | 4.435935199 |
| SEQ ID 282 | 22 | 16661122 | 16685770 | 24648 | loss | 1780 | MICAL3 | Exon+ve, ≥2 cases | 4.435935199 |
| SEQ ID 283 | 22 | 16655966 | 16680825 | 24859 | loss | 2034 | MICAL3 | Exon+ve, ≥2 cases | 4.435935199 |
| SEQ ID 284 | 19 | 23776795 | 23805817 | 29022 | gain | 1783 | RPSAP58 | Exon+ve, ≥2 cases | 4.435935199 |
| SEQ ID 285 | 16 | 74099704 | 74137609 | 37905 | gain | 1879 | TMEM231, CHST5 | Exon+ve, ≥2 cases | 4.435935199 |
| SEQ ID 286 | 16 | 74097511 | 74144645 | 47134 | gain | 2032 | TMEM231, CHST5 | Exon+ve, ≥2 cases | 4.435935199 |
| SEQ ID 287 | 16 | 74097511 | 74146468 | 48957 | gain | 1993 | TMEM231, CHST5 | Exon+ve, ≥2 cases | 4.435935199 |
| SEQ ID 288 | 19 | 61823068 | 62665957 | 842889 | loss | 1461 | TRAPPC2P1, ZNF835, USP29, ZNF17, ZNF71, ZNF749, ZNF264, LOC147670, VN1R1, AURKC, PEG3-AS1, ZIM2, ZIM3, ZNF304, ZNF805, ZNF547, ZNF543, MIMT1, ZNF460, DUXA, ZNF548, PEG3 | Exon+ve, ≥2 cases | 4.435935199 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 289 | 9 | 98831789 | 98831814 | 25 | gain | 1629 | CTSL2 | Exon+ve, ≥2 cases | 4.435935199 |
| SEQ ID 289 | 9 | 98831789 | 98831814 | 25 | loss | 1715 | CTSL2 | Exon+ve, ≥2 cases | 4.435935199 |
| SEQ ID 289 | 9 | 98831789 | 98831814 | 25 | loss | 1718 | CTSL2 | Exon+ve, ≥2 cases | 4.435935199 |
| SEQ ID 290 | X | 12833576 | 12834706 | 1130 | loss | 1633 | TLR8, LOC349408 | Exon+ve, ≥2 cases | 4.435935199 |
| SEQ ID 290 | X | 12833576 | 12834706 | 1130 | loss | 1901 | TLR8, LOC349408 | Exon+ve, ≥2 cases | 4.435935199 |
| SEQ ID 290 | X | 12833576 | 12834706 | 1130 | loss | 2024 | TLR8, LOC349408 | Exon+ve, ≥2 cases | 4.435935199 |
| SEQ ID 291 | 1 | 22787161 | 22788440 | 1279 | loss | 1278 | EPHA8 | Exon+ve, ≥2 cases | 4.435935199 |
| SEQ ID 291 | 1 | 22787161 | 22788440 | 1279 | loss | 1687 | EPHA8 | Exon+ve, ≥2 cases | 4.435935199 |
| SEQ ID 291 | 1 | 22787161 | 22788440 | 1279 | loss | 1895 | EPHA8 | Exon+ve, ≥2 cases | 4.435935199 |
| SEQ ID 292 | 6 | 149109599 | 149110881 | 1282 | loss | 1369 | UST | Exon+ve, ≥2 cases | 4.435935199 |
| SEQ ID 292 | 6 | 149109599 | 149110881 | 1282 | loss | 1645 | UST | Exon+ve, ≥2 cases | 4.435935199 |
| SEQ ID 293 | 4 | 47358255 | 47359575 | 1320 | gain | 1658 | CORIN | Exon+ve, ≥2 cases | 4.435935199 |
| SEQ ID 294 | 1 | 91946409 | 91948225 | 1816 | loss | 1656 | TGFBR3 | Exon+ve, ≥2 cases | 4.435935199 |
| SEQ ID 294 | 1 | 91946409 | 91948225 | 1816 | loss | 2043 | TGFBR3 | Exon+ve, ≥2 cases | 4.435935199 |
| SEQ ID 295 | 13 | 42366568 | 42368413 | 1845 | loss | 1536 | EPSTI1 | Exon+ve, distinct CNVs, same Gene | 4.435935199 |
| SEQ ID 296 | 6 | 146912375 | 146914496 | 2121 | loss | 1291 | RAB32 | Exon+ve, ≥2 cases | 4.435935199 |
| SEQ ID 296 | 6 | 146912375 | 146914496 | 2121 | loss | 1309 | RAB32 | Exon+ve, ≥2 cases | 4.435935199 |
| SEQ ID 297 | 3 | 9720244 | 9722646 | 2402 | gain | 1264 | CPNE9 | Exon+ve, ≥2 cases | 4.435935199 |
| SEQ ID 297 | 3 | 9720244 | 9722646 | 2402 | gain | 1587 | CPNE9 | Exon+ve, ≥2 cases | 4.435935199 |
| SEQ ID 297 | 3 | 9720244 | 9722646 | 2402 | gain | 1618 | CPNE9 | Exon+ve, ≥2 cases | 4.435935199 |
| SEQ ID 298 | 14 | 51528998 | 51531503 | 2505 | loss | 1226 | C14orf166 | Exon+ve, ≥2 cases | 4.435935199 |
| SEQ ID 298 | 14 | 51528998 | 51531503 | 2505 | loss | 1253 | C14orf166 | Exon+ve, ≥2 cases | 4.435935199 |
| SEQ ID 298 | 14 | 51528998 | 51531503 | 2505 | loss | 1650 | C14orf166 | Exon+ve, ≥2 cases | 4.435935199 |
| SEQ ID 299 | 15 | 99236636 | 99239178 | 2542 | loss | 1544 | ALDH1A3 | Exon+ve, ≥2 cases | 4.435935199 |
| SEQ ID 299 | 15 | 99236636 | 99239178 | 2542 | loss | 1626 | ALDH1A3 | Exon+ve, ≥2 cases | 4.435935199 |
| SEQ ID 299 | 15 | 99236636 | 99239178 | 2542 | gain | 1644 | ALDH1A3 | Exon+ve, ≥2 cases | 4.435935199 |
| SEQ ID 300 | 15 | 87999026 | 88001610 | 2584 | loss | 1738 | KIF7 | Exon+ve, ≥2 cases | 4.435935199 |
| SEQ ID 265 | 2 | 1469952 | 1472562 | 2610 | loss | 1510 | TPO | Exon+ve, ≥2 cases | 4.435935199 |
| SEQ ID 301 | 19 | 59180503 | 59183718 | 3215 | loss | 1966 | CACNG8 | Exon+ve, ≥2 cases | 4.435935199 |
| SEQ ID 302 | 5 | 90081197 | 90084436 | 3239 | gain | 1489 | GPR98 | Exon+ve, ≥2 cases | 4.435935199 |
| SEQ ID 303 | 2 | 106174179 | 106177686 | 3507 | loss | 1505 | UXS1 | Exon+ve, ≥2 cases | 4.435935199 |
| SEQ ID 303 | 2 | 106174179 | 106177686 | 3507 | loss | 1611 | UXS1 | Exon+ve, ≥2 cases | 4.435935199 |
| SEQ ID 304 | 4 | 47358255 | 47361851 | 3596 | gain | 1252 | CORIN | Exon+ve, ≥2 cases | 4.435935199 |
| SEQ ID 305 | 3 | 33868917 | 33873484 | 4567 | loss | 1259 | PDCD6IP | Exon+ve, ≥2 cases | 4.435935199 |
| SEQ ID 305 | 3 | 33868917 | 33873484 | 4567 | loss | 1274 | PDCD6IP | Exon+ve, ≥2 cases | 4.435935199 |
| SEQ ID 305 | 3 | 33868917 | 33873484 | 4567 | loss | 1724 | PDCD6IP | Exon+ve, ≥2 cases | 4.435935199 |
| SEQ ID 306 | 19 | 59179146 | 59183718 | 4572 | loss | 1953 | CACNG8 | Exon+ve, ≥2 cases | 4.435935199 |
| SEQ ID 307 | 2 | 43857496 | 43862163 | 4667 | loss | 1688 | DYNC2LI1 | Exon+ve, ≥2 cases | 4.435935199 |
| SEQ ID 307 | 2 | 43857496 | 43862163 | 4667 | loss | 1786 | DYNC2LI1 | Exon+ve, ≥2 cases | 4.435935199 |
| SEQ ID 307 | 2 | 43857496 | 43862163 | 4667 | loss | 1790 | DYNC2LI1 | Exon+ve, ≥2 cases | 4.435935199 |
| SEQ ID 308 | 10 | 68606250 | 68611060 | 4810 | loss | 1970 | CTNNA3 | Exon+ve, distinct CNVs, same Gene | 4.435935199 |
| SEQ ID 309 | 15 | 87996761 | 88001610 | 4849 | loss | 1317 | KIF7 | Exon+ve, ≥2 cases | 4.435935199 |
| SEQ ID 310 | 19 | 59177873 | 59183718 | 5845 | loss | 1720 | CACNG8 | Exon+ve, ≥2 cases | 4.435935199 |
| SEQ ID 311 | 6 | 146908491 | 146914496 | 6005 | loss | 1535 | RAB32 | Exon+ve, ≥2 cases | 4.435935199 |
| SEQ ID 312 | 7 | 99028753 | 99035131 | 6378 | gain | 1411 | LOC100289187 | Exon+ve, ≥2 cases | 4.435935199 |
| SEQ ID 312 | 7 | 99028753 | 99035131 | 6378 | gain | 1755 | LOC100289187 | Exon+ve, ≥2 cases | 4.435935199 |
| SEQ ID 313 | 7 | 99028753 | 99037212 | 8459 | gain | 1799 | LOC100289187 | Exon+ve, ≥2 cases | 4.435935199 |
| SEQ ID 314 | 3 | 197848634 | 197857567 | 8933 | loss | 1285 | LRRC33 | Exon+ve, ≥2 cases | 4.435935199 |
| SEQ ID 315 | 3 | 197276556 | 197285789 | 9233 | gain | 1565 | TFRC | Exon+ve, ≥2 cases | 4.435935199 |
| SEQ ID 316 | 19 | 12026895 | 12036294 | 9399 | loss | 1333 | ZNF878 | Exon+ve, ≥2 cases | 4.435935199 |
| SEQ ID 316 | 19 | 12026895 | 12036294 | 9399 | loss | 1391 | ZNF878 | Exon+ve, ≥2 cases | 4.435935199 |
| SEQ ID 316 | 19 | 12026895 | 12036294 | 9399 | loss | 1742 | ZNF878 | Exon+ve, ≥2 cases | 4.435935199 |
| SEQ ID 317 | 9 | 73771180 | 73780717 | 9537 | gain | 1793 | C9orf85 | Exon+ve, ≥2 cases | 4.435935199 |
| SEQ ID 317 | 9 | 73771180 | 73780717 | 9537 | gain | 1883 | C9orf85 | Exon+ve, ≥2 cases | 4.435935199 |
| SEQ ID 318 | 16 | 73305631 | 73315221 | 9590 | loss | 1918 | FA2H | Exon+ve, ≥2 cases | 4.435935199 |
| SEQ ID 319 | 9 | 73771087 | 73780717 | 9630 | gain | 1893 | C9orf85 | Exon+ve, ≥2 cases | 4.435935199 |
| SEQ ID 320 | 3 | 58161589 | 58171419 | 9830 | gain | 1267 | DNASE1L3 | Exon+ve, ≥2 cases | 4.435935199 |
| SEQ ID 320 | 3 | 58161589 | 58171419 | 9830 | gain | 1268 | DNASE1L3 | Exon+ve, ≥2 cases | 4.435935199 |
| SEQ ID 320 | 3 | 58161589 | 58171419 | 9830 | gain | 1354 | DNASE1L3 | Exon+ve, ≥2 cases | 4.435935199 |
| SEQ ID 321 | 2 | 106174179 | 106184290 | 10111 | loss | 1697 | UXS1 | Exon+ve, ≥2 cases | 4.435935199 |
| SEQ ID 322 | 3 | 197848634 | 197859317 | 10683 | loss | 1909 | LRRC33 | Exon+ve, ≥2 cases | 4.435935199 |
| SEQ ID 323 | 16 | 73303266 | 73315221 | 11955 | loss | 1293 | FA2H | Exon+ve, ≥2 cases | 4.435935199 |
| SEQ ID 323 | 16 | 73303266 | 73315221 | 11955 | loss | 1297 | FA2H | Exon+ve, ≥2 cases | 4.435935199 |
| SEQ ID 324 | 3 | 197846987 | 197859317 | 12330 | loss | 2030 | LRRC33 | Exon+ve, ≥2 cases | 4.435935199 |
| SEQ ID 325 | 16 | 22071418 | 22084314 | 12896 | gain | 1946 | VWA3A | Exon+ve, ≥2 cases | 4.435935199 |
| SEQ ID 325 | 16 | 22071418 | 22084314 | 12896 | gain | 1962 | VWA3A | Exon+ve, ≥2 cases | 4.435935199 |
| SEQ ID 326 | 16 | 3047597 | 3065241 | 17644 | loss | 1585 | MMP25, IL32 | Exon+ve, ≥2 cases | 4.435935199 |
| SEQ ID 326 | 16 | 3047597 | 3065241 | 17644 | loss | 1919 | MMP25, IL32 | Exon+ve, ≥2 cases | 4.435935199 |
| SEQ ID 327 | 4 | 47314693 | 47335844 | 21151 | loss | 1308 | CORIN | Exon+ve, distinct CNVs, same Gene | 4.435935199 |
| SEQ ID 328 | 16 | 3044051 | 3065241 | 21190 | loss | 1804 | MMP25, IL32 | Exon+ve, ≥2 cases | 4.435935199 |
| SEQ ID 329 | 10 | 42318589 | 42340738 | 22149 | gain | 1299 | ZNF37BP | Exon+ve, ≥2 cases | 4.435935199 |
| SEQ ID 330 | 17 | 6673256 | 6695979 | 22723 | gain | 1600 | TEKT1 | Exon+ve, ≥2 cases | 4.435935199 |
| SEQ ID 331 | 6 | 149098235 | 149121186 | 22951 | loss | 1660 | UST | Exon+ve, ≥2 cases | 4.435935199 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 332 | 9 | 116122595 | 116146858 | 24263 | loss | 1301 | ORM1, ORM2, AKNA | Exon+ve, ≥2 cases | 4.435935199 |
| SEQ ID 333 | 9 | 5632749 | 5660083 | 27334 | gain | 1463 | KIAA1432 | Exon+ve, ≥2 cases | 4.435935199 |
| SEQ ID 334 | 9 | 5634019 | 5661740 | 27721 | gain | 1818 | KIAA1432 | Exon+ve, ≥2 cases | 4.435935199 |
| SEQ ID 335 | 3 | 48583014 | 48611409 | 28395 | loss | 1428 | MIR711, COL7A1, UQCRC1 | Exon+ve, ≥2 cases | 4.435935199 |
| SEQ ID 336 | 9 | 5632749 | 5661740 | 28991 | gain | 1667 | KIAA1432 | Exon+ve, ≥2 cases | 4.435935199 |
| SEQ ID 337 | 9 | 79037727 | 79067111 | 29384 | gain | 1782 | VPS13A | Exon+ve, ≥2 cases | 4.435935199 |
| SEQ ID 337 | 9 | 79037727 | 79067111 | 29384 | gain | 1897 | VPS13A | Exon+ve, ≥2 cases | 4.435935199 |
| SEQ ID 337 | 9 | 79037727 | 79067111 | 29384 | gain | 1938 | VPS13A | Exon+ve, ≥2 cases | 4.435935199 |
| SEQ ID 338 | 13 | 42369769 | 42423317 | 53548 | gain | 1502 | EPSTI1 | Exon+ve, ≥2 cases | 4.435935199 |
| SEQ ID 339 | 9 | 116088109 | 116142499 | 54390 | gain | 1406 | COL27A1, ORM1, ORM2, AKNA | Exon+ve, ≥2 cases | 4.435935199 |
| SEQ ID 340 | 9 | 116088109 | 116144225 | 56116 | gain | 2020 | COL27A1, ORM1, ORM2, AKNA | Exon+ve, ≥2 cases | 4.435935199 |
| SEQ ID 341 | 10 | 69018417 | 69100982 | 82565 | gain | 1780 | CTNNA3 | Exon+ve, distinct CNVs, same Gene | 4.435935199 |
| SEQ ID 342 | 3 | 48575894 | 48667744 | 91850 | loss | 2035 | TMEM89, COL7A1, CELSR3, MIR711, SLC26A6, UCN2, UQCRC1 | | 4.435935199 |
| SEQ ID 343 | 15 | 87901294 | 88001610 | 100316 | gain | 1548 | KIF7, C15orf42 | Exon+ve, ≥2 cases | 4.435935199 |
| SEQ ID 344 | 3 | 48575894 | 48677740 | 101846 | loss | 1969 | TMEM89, COL7A1, CELSR3, MIR711, SLC26A6, UCN2, UQCRC1 | | 4.435935199 |
| SEQ ID 345 | 17 | 6699298 | 6804062 | 104764 | loss | 1600 | ALOX12P2 | Exon+ve, ≥2 cases | 4.435935199 |
| SEQ ID 346 | 4 | 191041481 | 191153613 | 112132 | gain | 1230 | FRG1, TUBB4Q | Exon+ve, ≥2 cases | 4.435935199 |
| SEQ ID 346 | 4 | 191041481 | 191153613 | 112132 | gain | 1292 | FRG1, TUBB4Q | Exon+ve, ≥2 cases | 4.435935199 |
| SEQ ID 347 | 3 | 197289125 | 197410852 | 121727 | gain | 1565 | LOC401109, TFRC, ZDHHC19 | Exon+ve, ≥2 cases | 4.435935199 |
| SEQ ID 348 | 10 | 67627258 | 67751642 | 124384 | loss | 1835 | CTNNA3 | Exon+ve, distinct CNVs, same Gene | 4.435935199 |
| SEQ ID 349 | 4 | 190982421 | 191133609 | 151188 | gain | 1411 | FRG1 | Exon+ve, ≥2 cases | 4.435935199 |
| SEQ ID 350 | 17 | 6571330 | 6745640 | 174310 | loss | 1927 | TEKT1, ALOX12P2, XAF1, FBXO39 | Exon+ve, ≥2 cases | 4.435935199 |
| SEQ ID 351 | 1 | 91915756 | 92093883 | 178127 | gain | 1405 | TGFBR3 | Exon+ve, ≥2 cases | 4.435935199 |
| SEQ ID 352 | 13 | 42372718 | 42687363 | 314645 | gain | 1897 | ENOX1, DNAJC15, EPSTI1 | Exon+ve, ≥2 cases | 4.435935199 |
| SEQ ID 353 | 1 | 144099302 | 144458571 | 359269 | loss | 1874 | RNF115, RBM8A, GNRHR2, CD160, HFE2, ANKRD34A, LIX1L, POLR3GL, ANKRD35, ITGA10, PEX11B, NUDT17, TXNIP, PDZK1, POLR3C, PIAS3 | Exon+ve, ≥2 cases | 4.435935199 |
| SEQ ID 354 | 3 | 197135314 | 197531031 | 395717 | gain | 1227 | PCYT1A, TM4SF19-TCTEX1D2, ZDHHC19, OSTalpha, TFRC, LOC401109, TCTEX1D2, SDHAP1 | Exon+ve, ≥2 cases | 4.435935199 |
| SEQ ID 355 | 1 | 144099302 | 144544352 | 445050 | gain | 1599 | RNF115, GPR89A, RBM8A, GNRHR2, CD160, HFE2, ANKRD34A, LIX1L, POLR3GL, ANKRD35, ITGA10, PEX11B, NUDT17, TXNIP, PDZK1, POLR3C, PIAS3 | Exon+ve, ≥2 cases | 4.435935199 |
| SEQ ID 355 | 1 | 144099302 | 144544352 | 445050 | gain | 1968 | RNF115, GPR89A, RBM8A, GNRHR2, CD160, HFE2, ANKRD34A, LIX1L, POLR3GL, ANKRD35, ITGA10, PEX11B, NUDT17, TXNIP, PDZK1, POLR3C, PIAS3 | Exon+ve, ≥2 cases | 4.435935199 |
| SEQ ID 356 | 16 | 21858880 | 22338034 | 479154 | gain | 1426 | EEF2K, CDR2, POLR3E, C16orf52, UQCRC2, PDZD9, VWA3A | Exon+ve, ≥2 cases | 4.435935199 |
| SEQ ID 357 | 5 | 89477991 | 90142704 | 664713 | gain | 1786 | LYSMD3, POLR3G, CETN3, MBLAC2, GPR98 | Exon+ve, ≥2 cases | 4.435935199 |
| SEQ ID 357 | 5 | 89477991 | 90142704 | 664713 | gain | 1886 | LYSMD3, POLR3G, CETN3, MBLAC2, GPR98 | Exon+ve, ≥2 cases | 4.435935199 |
| SEQ ID 358 | 10 | 42601499 | 43277721 | 676222 | gain | 1968 | RASGEF1A, BMS1, ZNF487P, FXYD4, RET, CSGALNACT2, HNRNPF | Exon+ve, ≥2 cases | 4.435935199 |
| SEQ ID 359 | 10 | 41971605 | 43049635 | 1078030 | gain | 1746 | RASGEF1A, BMS1, ZNF37BP, RET, LOC441666, ZNF33B, LOC84856, CSGALNACT2 | Exon+ve, ≥2 cases | 4.435935199 |
| SEQ ID 360 | 4 | 149047165 | 149047423 | 258 | loss | 1498 | ARHGAP10 | Exon+ve, ≥2 cases | 2.952941176 |
| SEQ ID 360 | 4 | 149047165 | 149047423 | 258 | loss | 1916 | ARHGAP10 | Exon+ve, ≥2 cases | 2.952941176 |
| SEQ ID 361 | 11 | 95194789 | 95195561 | 772 | loss | 1349 | CEP57 | Exon+ve, ≥2 cases | 2.952941176 |
| SEQ ID 361 | 11 | 95194789 | 95195561 | 772 | loss | 1946 | CEP57 | Exon+ve, ≥2 cases | 2.952941176 |
| SEQ ID 362 | 22 | 45453176 | 45454102 | 926 | gain | 1660 | GRAMD4 | Exon+ve, ≥2 cases | 2.952941176 |
| SEQ ID 362 | 22 | 45453176 | 45454102 | 926 | gain | 1880 | GRAMD4 | Exon+ve, ≥2 cases | 2.952941176 |
| SEQ ID 363 | X | 13695016 | 13696059 | 1043 | gain | 1590 | OFD1 | Exon+ve, ≥2 cases | 2.952941176 |
| SEQ ID 364 | 14 | 99827183 | 99828301 | 1118 | gain | 1790 | SLC25A29 | Exon+ve, distinct CNVs, same Gene | 2.952941176 |
| SEQ ID 365 | 1 | 206023028 | 206024152 | 1124 | loss | 1724 | CD46 | Exon+ve, ≥2 cases | 2.952941176 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 366 | 8 | 42134084 | 42135245 | 1161 | loss | 1251 | AP3M2 | Exon+ve, distinct CNVs, same Gene | 2.952941176 |
| SEQ ID 367 | 19 | 58919358 | 58920523 | 1165 | gain | 1585 | MIR516B2 | Exon+ve, ≥2 cases | 2.952941176 |
| SEQ ID 368 | 1 | 156784465 | 156785660 | 1195 | loss | 1877 | OR6Y1 | Exon+ve, ≥2 cases | 2.952941176 |
| SEQ ID 369 | 4 | 56070868 | 56072259 | 1391 | loss | 1529 | CLOCK | Exon+ve, ≥2 cases | 2.952941176 |
| SEQ ID 370 | X | 13673158 | 13674550 | 1392 | loss | 1320 | OFD1 | Exon+ve, ≥2 cases | 2.952941176 |
| SEQ ID 371 | 2 | 179837050 | 179838443 | 1393 | loss | 1727 | SESTD1 | Exon+ve, ≥2 cases | 2.952941176 |
| SEQ ID 372 | 20 | 33633288 | 33634683 | 1395 | loss | 1774 | FER1L4 | Exon+ve, ≥2 cases | 2.952941176 |
| SEQ ID 373 | 14 | 99828301 | 99829704 | 1403 | loss | 1705 | SLC25A29 | Exon+ve, distinct CNVs, same Gene | 2.952941176 |
| SEQ ID 374 | X | 40940810 | 40942301 | 1491 | loss | 1583 | USP9X | Exon+ve, ≥2 cases | 2.952941176 |
| SEQ ID 375 | 12 | 9777077 | 9778598 | 1521 | loss | 1264 | CLECL1 | Exon+ve, ≥2 cases | 2.952941176 |
| SEQ ID 375 | 12 | 9777077 | 9778598 | 1521 | loss | 1705 | CLECL1 | Exon+ve, ≥2 cases | 2.952941176 |
| SEQ ID 376 | 16 | 28073908 | 28075568 | 1660 | loss | 1295 | XPO6 | Exon+ve, ≥2 cases | 2.952941176 |
| SEQ ID 376 | 16 | 28073908 | 28075568 | 1660 | loss | 1917 | XPO6 | Exon+ve, ≥2 cases | 2.952941176 |
| SEQ ID 377 | 3 | 155353325 | 155355022 | 1697 | gain | 1371 | ARHGEF26 | Exon+ve, distinct CNVs, same Gene | 2.952941176 |
| SEQ ID 378 | 5 | 14333156 | 14334923 | 1767 | gain | 1417 | TRIO | Exon+ve, distinct CNVs, same Gene | 2.952941176 |
| SEQ ID 379 | 11 | 22198120 | 22199909 | 1789 | loss | 2001 | ANO5 | Exon+ve, ≥2 cases | 2.952941176 |
| SEQ ID 380 | 11 | 125808845 | 125810734 | 1889 | gain | 1861 | KIRREL3 | Exon+ve, ≥2 cases | 2.952941176 |
| SEQ ID 381 | 2 | 30306530 | 30308506 | 1976 | loss | 1429 | LBH | Exon+ve, ≥2 cases | 2.952941176 |
| SEQ ID 381 | 2 | 30306530 | 30308506 | 1976 | loss | 1884 | LBH | Exon+ve, ≥2 cases | 2.952941176 |
| SEQ ID 382 | X | 29595687 | 29597689 | 2002 | loss | 1506 | IL1RAPL1 | Exon+ve, ≥2 cases | 2.952941176 |
| SEQ ID 382 | X | 29595687 | 29597689 | 2002 | loss | 1811 | IL1RAPL1 | Exon+ve, ≥2 cases | 2.952941176 |
| SEQ ID 383 | 11 | 127895094 | 127897121 | 2027 | gain | 1429 | ETS1 | Exon+ve, ≥2 cases | 2.952941176 |
| SEQ ID 383 | 11 | 127895094 | 127897121 | 2027 | gain | 1779 | ETS1 | Exon+ve, ≥2 cases | 2.952941176 |
| SEQ ID 384 | X | 105750701 | 105752733 | 2032 | loss | 1239 | CXorf57 | Exon+ve, ≥2 cases | 2.952941176 |
| SEQ ID 384 | X | 105750701 | 105752733 | 2032 | loss | 1372 | CXorf57 | Exon+ve, ≥2 cases | 2.952941176 |
| SEQ ID 385 | 14 | 30647372 | 30649432 | 2060 | loss | 1775 | HECTD1 | Exon+ve, distinct CNVs, same Gene | 2.952941176 |
| SEQ ID 386 | 2 | 106784966 | 106787143 | 2177 | loss | 1592 | ST6GAL2 | Exon+ve, ≥2 cases | 2.952941176 |
| SEQ ID 386 | 2 | 106784966 | 106787143 | 2177 | loss | 1720 | ST6GAL2 | Exon+ve, ≥2 cases | 2.952941176 |
| SEQ ID 387 | 20 | 30793762 | 30795954 | 2192 | loss | 1241 | COMMD7 | Exon+ve, ≥2 cases | 2.952941176 |
| SEQ ID 388 | 16 | 88409839 | 88412033 | 2194 | gain | 1877 | FANCA | Exon+ve, distinct CNVs, same Gene | 2.952941176 |
| SEQ ID 389 | 12 | 21514182 | 21516409 | 2227 | gain | 1465 | RECQL, PYROXD1 | Exon+ve, ≥2 cases | 2.952941176 |
| SEQ ID 389 | 12 | 21514182 | 21516409 | 2227 | gain | 1925 | RECQL, PYROXD1 | Exon+ve, ≥2 cases | 2.952941176 |
| SEQ ID 390 | 16 | 31485690 | 31487952 | 2262 | gain | 1524 | CSDAP1 | Exon+ve, ≥2 cases | 2.952941176 |
| SEQ ID 391 | 3 | 155389583 | 155391992 | 2409 | gain | 1446 | ARHGEF26 | Exon+ve, distinct CNVs, same Gene | 2.952941176 |
| SEQ ID 392 | 20 | 33633288 | 33635789 | 2501 | loss | 1419 | FER1L4 | Exon+ve, ≥2 cases | 2.952941176 |
| SEQ ID 393 | X | 137525298 | 137527811 | 2513 | gain | 1223 | LOC158696 | Exon+ve, ≥2 cases | 2.952941176 |
| SEQ ID 393 | X | 137525298 | 137527811 | 2513 | gain | 2041 | LOC158696 | Exon+ve, ≥2 cases | 2.952941176 |
| SEQ ID 394 | 7 | 6004111 | 6006782 | 2671 | gain | 1266 | PMS2 | Exon+ve, ≥2 cases | 2.952941176 |
| SEQ ID 394 | 7 | 6004111 | 6006782 | 2671 | gain | 1938 | PMS2 | Exon+ve, ≥2 cases | 2.952941176 |
| SEQ ID 395 | 1 | 93492660 | 93495455 | 2795 | gain | 1832 | CCDC18 | Exon+ve, ≥2 cases | 2.952941176 |
| SEQ ID 395 | 1 | 93492660 | 93495455 | 2795 | gain | 2032 | CCDC18 | Exon+ve, ≥2 cases | 2.952941176 |
| SEQ ID 396 | 2 | 44403707 | 44406514 | 2807 | gain | 1826 | PREPL | Exon+ve, ≥2 cases | 2.952941176 |
| SEQ ID 397 | 1 | 156784465 | 156787318 | 2853 | loss | 1858 | OR6Y1 | Exon+ve, ≥2 cases | 2.952941176 |
| SEQ ID 398 | 14 | 22811680 | 22814547 | 2867 | gain | 1642 | HOMEZ | Exon+ve, ≥2 cases | 2.952941176 |
| SEQ ID 398 | 14 | 22811680 | 22814547 | 2867 | gain | 1875 | HOMEZ | Exon+ve, ≥2 cases | 2.952941176 |
| SEQ ID 399 | 15 | 41098343 | 41101310 | 2967 | loss | 1630 | UBR1 | Exon+ve, ≥2 cases | 2.952941176 |
| SEQ ID 399 | 15 | 41098343 | 41101310 | 2967 | loss | 2018 | UBR1 | Exon+ve, ≥2 cases | 2.952941176 |
| SEQ ID 400 | 22 | 37737241 | 37740258 | 3017 | loss | 1959 | APOBEC3C | Exon+ve, ≥2 cases | 2.952941176 |
| SEQ ID 400 | 22 | 37737241 | 37740258 | 3017 | loss | 1965 | APOBEC3C | Exon+ve, ≥2 cases | 2.952941176 |
| SEQ ID 401 | 10 | 118190679 | 118193786 | 3107 | loss | 1287 | PNLIPRP3 | Exon+ve, ≥2 cases | 2.952941176 |
| SEQ ID 402 | 9 | 32459710 | 32463040 | 3330 | loss | 2003 | DDX58 | Exon+ve, distinct CNVs, same Gene | 2.952941176 |
| SEQ ID 403 | 8 | 67685665 | 67689015 | 3350 | loss | 1275 | MYBL1 | Exon+ve, ≥2 cases | 2.952941176 |
| SEQ ID 403 | 8 | 67685665 | 67689015 | 3350 | loss | 1650 | MYBL1 | Exon+ve, ≥2 cases | 2.952941176 |
| SEQ ID 404 | 12 | 108878848 | 108882203 | 3355 | loss | 1279 | GIT2 | Exon+ve, ≥2 cases | 2.952941176 |
| SEQ ID 404 | 12 | 108878848 | 108882203 | 3355 | loss | 1665 | GIT2 | Exon+ve, ≥2 cases | 2.952941176 |
| SEQ ID 405 | 8 | 54952820 | 54956193 | 3373 | loss | 1604 | RGS20 | Exon+ve, ≥2 cases | 2.952941176 |
| SEQ ID 406 | 3 | 46687043 | 46690457 | 3414 | loss | 1834 | ALS2CL | Exon+ve, ≥2 cases | 2.952941176 |
| SEQ ID 407 | 8 | 42145982 | 42149494 | 3512 | gain | 1634 | AP3M2 | Exon+ve, distinct CNVs, same Gene | 2.952941176 |
| SEQ ID 408 | 11 | 110872005 | 110875598 | 3593 | loss | 1465 | BTG4 | Exon+ve, ≥2 cases | 2.952941176 |
| SEQ ID 409 | X | 8960105 | 8963721 | 3616 | gain | 1454 | FAM9B | Exon+ve, ≥2 cases | 2.952941176 |
| SEQ ID 410 | 7 | 48528408 | 48532031 | 3623 | loss | 1891 | ABCA13 | Exon+ve, ≥2 cases | 2.952941176 |
| SEQ ID 411 | 3 | 96161892 | 96165551 | 3659 | loss | 1619 | LOC255025 | Exon+ve, ≥2 cases | 2.952941176 |
| SEQ ID 411 | 3 | 96161892 | 96165551 | 3659 | loss | 1624 | LOC255025 | Exon+ve, ≥2 cases | 2.952941176 |
| SEQ ID 412 | 7 | 133906667 | 133910372 | 3705 | gain | 1783 | AKR1B15 | Exon+ve, ≥2 cases | 2.952941176 |
| SEQ ID 413 | X | 40938342 | 40942301 | 3959 | loss | 1415 | USP9X | Exon+ve, ≥2 cases | 2.952941176 |
| SEQ ID 414 | 9 | 6606637 | 6610662 | 4025 | loss | 1391 | GLDC | Exon+ve, distinct CNVs, same Gene | 2.952941176 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 415 | 17 | 38282993 | 38287021 | 4028 | loss | 1295 | LOC388387 | Exon+ve, ≥2 cases | 2.952941176 |
| SEQ ID 415 | 17 | 38282993 | 38287021 | 4028 | loss | 1470 | LOC388387 | Exon+ve, ≥2 cases | 2.952941176 |
| SEQ ID 416 | 4 | 68168394 | 68172597 | 4203 | loss | 1221 | UBA6 | Exon+ve, ≥2 cases | 2.952941176 |
| SEQ ID 416 | 4 | 68168394 | 68172597 | 4203 | loss | 1222 | UBA6 | Exon+ve, ≥2 cases | 2.952941176 |
| SEQ ID 417 | 6 | 166499289 | 166503493 | 4204 | loss | 1859 | T | Exon+ve, distinct CNVs, same Gene | 2.952941176 |
| SEQ ID 418 | 1 | 206019923 | 206024152 | 4229 | loss | 1843 | CD46 | Exon+ve, ≥2 cases | 2.952941176 |
| SEQ ID 419 | 17 | 37790601 | 37795135 | 4534 | loss | 1659 | STAT3 | Exon+ve, ≥2 cases | 2.952941176 |
| SEQ ID 419 | 17 | 37790601 | 37795135 | 4534 | loss | 1887 | STAT3 | Exon+ve, ≥2 cases | 2.952941176 |
| SEQ ID 420 | 4 | 107311633 | 107316223 | 4590 | loss | 1280 | TBCK | Exon+ve, ≥2 cases | 2.952941176 |
| SEQ ID 420 | 4 | 107311633 | 107316223 | 4590 | loss | 1933 | TBCK | Exon+ve, ≥2 cases | 2.952941176 |
| SEQ ID 421 | 4 | 39829776 | 39834522 | 4746 | loss | 1947 | N4BP2 | Exon+ve, ≥2 cases | 2.952941176 |
| SEQ ID 422 | 7 | 122051537 | 122056508 | 4971 | loss | 1354 | CADPS2 | Exon+ve, distinct CNVs, same Gene | 2.952941176 |
| SEQ ID 423 | 9 | 36263984 | 36268995 | 5011 | gain | 1716 | GNE | Exon+ve, ≥2 cases | 2.952941176 |
| SEQ ID 423 | 9 | 36263984 | 36268995 | 5011 | gain | 1829 | GNE | Exon+ve, ≥2 cases | 2.952941176 |
| SEQ ID 424 | 18 | 17999811 | 18004912 | 5101 | loss | 1764 | GATA6 | Exon+ve, ≥2 cases | 2.952941176 |
| SEQ ID 424 | 18 | 17999811 | 18004912 | 5101 | loss | 1969 | GATA6 | Exon+ve, ≥2 cases | 2.952941176 |
| SEQ ID 425 | 5 | 128326107 | 128331280 | 5173 | loss | 1699 | SLC27A6 | Exon+ve, ≥2 cases | 2.952941176 |
| SEQ ID 426 | 1 | 243768850 | 243774213 | 5363 | loss | 1840 | KIF26B | Exon+ve, ≥2 cases | 2.952941176 |
| SEQ ID 427 | 11 | 63065110 | 63070503 | 5393 | loss | 1950 | RARRES3 | Exon+ve, ≥2 cases | 2.952941176 |
| SEQ ID 428 | 17 | 20154473 | 20159997 | 5524 | loss | 1988 | SPECC1 | Exon+ve, distinct CNVs, same Gene | 2.952941176 |
| SEQ ID 429 | 3 | 10249256 | 10254819 | 5563 | loss | 1920 | IRAK2 | Exon+ve, distinct CNVs, same Gene | 2.952941176 |
| SEQ ID 430 | 8 | 134336459 | 134342059 | 5600 | loss | 1552 | NDRG1 | Exon+ve, distinct CNVs, same Gene | 2.952941176 |
| SEQ ID 431 | 17 | 26220790 | 26226519 | 5729 | loss | 1238 | ATAD5 | Exon+ve, ≥2 cases | 2.952941176 |
| SEQ ID 431 | 17 | 26220790 | 26226519 | 5729 | loss | 1831 | ATAD5 | Exon+ve, ≥2 cases | 2.952941176 |
| SEQ ID 432 | 14 | 30649432 | 30655206 | 5774 | loss | 1403 | HECTD1 | Exon+ve, distinct CNVs, same Gene | 2.952941176 |
| SEQ ID 433 | 6 | 74521789 | 74527607 | 5818 | gain | 1638 | CD109 | Exon+ve, ≥2 cases | 2.952941176 |
| SEQ ID 434 | 16 | 20861337 | 20867356 | 6019 | loss | 1230 | DNAH3 | Exon+ve, ≥2 cases | 2.952941176 |
| SEQ ID 435 | 3 | 10210951 | 10217019 | 6068 | loss | 1247 | IRAK2 | Exon+ve, distinct CNVs, same Gene | 2.952941176 |
| SEQ ID 436 | 12 | 8173177 | 8179355 | 6178 | gain | 1246 | POU5F1P3, CLEC4A | Exon+ve, ≥2 cases | 2.952941176 |
| SEQ ID 436 | 12 | 8173177 | 8179355 | 6178 | gain | 1308 | POU5F1P3, CLEC4A | Exon+ve, ≥2 cases | 2.952941176 |
| SEQ ID 437 | 9 | 26919782 | 26925984 | 6202 | loss | 1539 | PLAA | Exon+ve, ≥2 cases | 2.952941176 |
| SEQ ID 438 | 5 | 95183456 | 95189721 | 6265 | gain | 1281 | GLRX | Exon+ve, ≥2 cases | 2.952941176 |
| SEQ ID 438 | 5 | 95183456 | 95189721 | 6265 | gain | 1824 | GLRX | Exon+ve, ≥2 cases | 2.952941176 |
| SEQ ID 439 | 8 | 54951684 | 54958115 | 6431 | loss | 1993 | RGS20 | Exon+ve, ≥2 cases | 2.952941176 |
| SEQ ID 440 | 22 | 48680818 | 48687314 | 6496 | loss | 1619 | ALG12 | Exon+ve, ≥2 cases | 2.952941176 |
| SEQ ID 440 | 22 | 48680818 | 48687314 | 6496 | loss | 1930 | ALG12 | Exon+ve, ≥2 cases | 2.952941176 |
| SEQ ID 441 | 8 | 134331224 | 134337808 | 6584 | gain | 1854 | NDRG1 | Exon+ve, distinct CNVs, same Gene | 2.952941176 |
| SEQ ID 442 | 22 | 22362348 | 22369101 | 6753 | gain | 1895 | LOC91316, RGL4 | Exon+ve, distinct CNVs, same Gene | 2.952941176 |
| SEQ ID 443 | 6 | 165748837 | 165755595 | 6758 | loss | 1590 | PDE10A | Exon+ve, ≥2 cases | 2.952941176 |
| SEQ ID 444 | 12 | 97699965 | 97706725 | 6760 | loss | 1884 | ANKS1B | Exon+ve, ≥2 cases | 2.952941176 |
| SEQ ID 445 | 22 | 16366605 | 16373481 | 6876 | loss | 1694 | CECR2 | Exon+ve, ≥2 cases | 2.952941176 |
| SEQ ID 446 | 1 | 19054398 | 19061530 | 7132 | loss | 1940 | TAS1R2 | Exon+ve, ≥2 cases | 2.952941176 |
| SEQ ID 447 | 5 | 37398626 | 37405778 | 7152 | loss | 1426 | NUP155 | Exon+ve, ≥2 cases | 2.952941176 |
| SEQ ID 448 | 9 | 32490919 | 32498096 | 7177 | loss | 1645 | DDX58 | Exon+ve, distinct CNVs, same Gene | 2.952941176 |
| SEQ ID 449 | 6 | 166487200 | 166494679 | 7479 | gain | 1392 | T | Exon+ve, distinct CNVs, same Gene | 2.952941176 |
| SEQ ID 450 | 1 | 47549912 | 47557441 | 7529 | loss | 1591 | STIL | Exon+ve, ≥2 cases | 2.952941176 |
| SEQ ID 450 | 1 | 47549912 | 47557441 | 7529 | loss | 1759 | STIL | Exon+ve, ≥2 cases | 2.952941176 |
| SEQ ID 451 | 4 | 99104657 | 99112516 | 7859 | gain | 1489 | C4orf37 | Exon+ve, distinct CNVs, same Gene | 2.952941176 |
| SEQ ID 452 | 11 | 63062641 | 63070503 | 7862 | loss | 1776 | RARRES3 | Exon+ve, ≥2 cases | 2.952941176 |
| SEQ ID 453 | 4 | 186681553 | 186689469 | 7916 | loss | 1458 | PDLIM3 | Exon+ve, ≥2 cases | 2.952941176 |
| SEQ ID 454 | 7 | 122003026 | 122010979 | 7953 | loss | 1910 | CADPS2 | Exon+ve, distinct CNVs, same Gene | 2.952941176 |
| SEQ ID 455 | 4 | 44319603 | 44327596 | 7993 | loss | 1487 | YIPF7 | Exon+ve, ≥2 cases | 2.952941176 |
| SEQ ID 455 | 4 | 44319603 | 44327596 | 7993 | loss | 1659 | YIPF7 | Exon+ve, ≥2 cases | 2.952941176 |
| SEQ ID 456 | 13 | 35691597 | 35699664 | 8067 | gain | 1803 | C13orf38-SOHLH2, C13orf38 | Exon+ve, ≥2 cases | 2.952941176 |
| SEQ ID 457 | 4 | 56070868 | 56079086 | 8218 | loss | 1738 | CLOCK | Exon+ve, ≥2 cases | 2.952941176 |
| SEQ ID 458 | 16 | 66830124 | 66838398 | 8274 | loss | 2023 | PLA2G15 | Exon+ve, ≥2 cases | 2.952941176 |
| SEQ ID 459 | 20 | 30787639 | 30795954 | 8315 | loss | 1901 | COMMD7 | Exon+ve, ≥2 cases | 2.952941176 |
| SEQ ID 460 | 1 | 201194532 | 201202914 | 8382 | loss | 1572 | CYB5R1 | Exon+ve, ≥2 cases | 2.952941176 |
| SEQ ID 460 | 1 | 201194532 | 201202914 | 8382 | loss | 1687 | CYB5R1 | Exon+ve, ≥2 cases | 2.952941176 |
| SEQ ID 461 | 19 | 12650727 | 12659347 | 8620 | loss | 1638 | DHPS | Exon+ve, ≥2 cases | 2.952941176 |
| SEQ ID 462 | 1 | 149957941 | 149966646 | 8705 | loss | 1867 | RIIAD1 | Exon+ve, ≥2 cases | 2.952941176 |
| SEQ ID 463 | 16 | 20861337 | 20870187 | 8850 | loss | 1760 | DNAH3 | Exon+ve, ≥2 cases | 2.952941176 |
| SEQ ID 464 | 19 | 12651862 | 12660732 | 8870 | loss | 1538 | FBXW9, DHPS | Exon+ve, ≥2 cases | 2.952941176 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 465 | 9 | 17347695 | 17356839 | 9144 | loss | 1502 | CNTLN | Exon+ve, distinct CNVs, same Gene | 2.952941176 |
| SEQ ID 466 | 8 | 82910933 | 82920255 | 9322 | loss | 1638 | SNX16 | Exon+ve, ≥2 cases | 2.952941176 |
| SEQ ID 466 | 8 | 82910933 | 82920255 | 9322 | loss | 1950 | SNX16 | Exon+ve, ≥2 cases | 2.952941176 |
| SEQ ID 467 | 1 | 177589995 | 177599597 | 9602 | loss | 1372 | SOAT1 | Exon+ve, ≥2 cases | 2.952941176 |
| SEQ ID 467 | 1 | 177589995 | 177599597 | 9602 | loss | 1635 | SOAT1 | Exon+ve, ≥2 cases | 2.952941176 |
| SEQ ID 468 | 7 | 86932062 | 86941683 | 9621 | loss | 1439 | ABCB4 | Exon+ve, ≥2 cases | 2.952941176 |
| SEQ ID 469 | 2 | 201773817 | 201783547 | 9730 | loss | 1534 | CASP10 | Exon+ve, ≥2 cases | 2.952941176 |
| SEQ ID 470 | 22 | 24636477 | 24646275 | 9798 | gain | 1348 | MIR1302-1, MYO18B | Exon+ve, ≥2 cases | 2.952941176 |
| SEQ ID 471 | 1 | 97937667 | 97947671 | 10004 | loss | 1221 | DPYD | Exon+ve, ≥2 cases | 2.952941176 |
| SEQ ID 472 | 2 | 48666246 | 48676336 | 10090 | gain | 1386 | STON1-GTF2A1L, STON1 | Exon+ve, distinct CNVs, same Gene | 2.952941176 |
| SEQ ID 473 | 9 | 17260655 | 17271186 | 10531 | loss | 1743 | CNTLN | Exon+ve, distinct CNVs, same Gene | 2.952941176 |
| SEQ ID 474 | 3 | 54504338 | 54514944 | 10606 | gain | 1293 | CACNA2D3 | Exon+ve, ≥2 cases | 2.952941176 |
| SEQ ID 474 | 3 | 54504338 | 54514944 | 10606 | gain | 1921 | CACNA2D3 | Exon+ve, ≥2 cases | 2.952941176 |
| SEQ ID 475 | 12 | 97694069 | 97704854 | 10785 | loss | 1872 | ANKS1B | Exon+ve, ≥2 cases | 2.952941176 |
| SEQ ID 476 | 22 | 16635762 | 16646613 | 10851 | loss | 1718 | BID | Exon+ve, ≥2 cases | 2.952941176 |
| SEQ ID 476 | 22 | 16635762 | 16646613 | 10851 | loss | 1859 | BID | Exon+ve, ≥2 cases | 2.952941176 |
| SEQ ID 477 | 17 | 19924055 | 19935009 | 10954 | loss | 2038 | SPECC1 | Exon+ve, distinct CNVs, same Gene | 2.952941176 |
| SEQ ID 478 | 5 | 150506984 | 150518075 | 11091 | loss | 1433 | ANXA6 | Exon+ve, ≥2 cases | 2.952941176 |
| SEQ ID 479 | 18 | 22717441 | 22728600 | 11159 | loss | 1442 | C18orf16 | Exon+ve, ≥2 cases | 2.952941176 |
| SEQ ID 480 | 7 | 100967884 | 100979053 | 11169 | loss | 1680 | EMID2 | Exon+ve, ≥2 cases | 2.952941176 |
| SEQ ID 481 | 22 | 16366605 | 16378078 | 11473 | loss | 1226 | CECR2 | Exon+ve, ≥2 cases | 2.952941176 |
| SEQ ID 482 | 1 | 110102580 | 110114121 | 11541 | loss | 1680 | EPS8L3 | Exon+ve, ≥2 cases | 2.952941176 |
| SEQ ID 483 | 4 | 39822903 | 39834522 | 11619 | loss | 1883 | N4BP2 | Exon+ve, ≥2 cases | 2.952941176 |
| SEQ ID 484 | 7 | 86930016 | 86941683 | 11667 | loss | 1579 | ABCB4 | Exon+ve, ≥2 cases | 2.952941176 |
| SEQ ID 485 | 14 | 69012378 | 69024166 | 11788 | loss | 1852 | UPF0639 | Exon+ve, ≥2 cases | 2.952941176 |
| SEQ ID 485 | 14 | 69012378 | 69024166 | 11788 | loss | 1871 | UPF0639 | Exon+ve, ≥2 cases | 2.952941176 |
| SEQ ID 486 | 18 | 22717441 | 22729467 | 12026 | loss | 1502 | C18orf16 | Exon+ve, ≥2 cases | 2.952941176 |
| SEQ ID 487 | 16 | 31384536 | 31396729 | 12193 | gain | 1232 | TGFB1I1, ARMC5 | Exon+ve, ≥2 cases | 2.952941176 |
| SEQ ID 487 | 16 | 31384536 | 31396729 | 12193 | gain | 1508 | TGFB1I1, ARMC5 | Exon+ve, ≥2 cases | 2.952941176 |
| SEQ ID 488 | 3 | 46677853 | 46690457 | 12604 | loss | 1318 | ALS2CL | Exon+ve, ≥2 cases | 2.952941176 |
| SEQ ID 489 | 3 | 38415026 | 38428090 | 13064 | loss | 1802 | XYLB | Exon+ve, ≥2 cases | 2.952941176 |
| SEQ ID 490 | 19 | 58910511 | 58923614 | 13103 | gain | 1606 | MIR526A2, MIR517B, MIR516B2, MIR520G, MIR520D, MIR521-2 | Exon+ve, ≥2 cases | 2.952941176 |
| SEQ ID 491 | 1 | 110102580 | 110115770 | 13190 | loss | 1802 | EPS8L3 | Exon+ve, ≥2 cases | 2.952941176 |
| SEQ ID 492 | 1 | 16578594 | 16591820 | 13226 | loss | 1315 | C1orf144 | Exon+ve, distinct CNVs, same Gene | 2.952941176 |
| SEQ ID 493 | 19 | 63655893 | 63669151 | 13258 | loss | 1454 | ZNF324B | Exon+ve, ≥2 cases | 2.952941176 |
| SEQ ID 494 | 13 | 35690487 | 35703802 | 13315 | gain | 1564 | C13orf38-SOHLH2, C13orf38 | Exon+ve, ≥2 cases | 2.952941176 |
| SEQ ID 495 | 1 | 19050716 | 19064092 | 13376 | gain | 1502 | TAS1R2 | Exon+ve, ≥2 cases | 2.952941176 |
| SEQ ID 496 | 11 | 65847130 | 65860867 | 13737 | loss | 1993 | RIN1 | Exon+ve, ≥2 cases | 2.952941176 |
| SEQ ID 497 | 16 | 66828576 | 66842374 | 13798 | loss | 1858 | PLA2G15 | Exon+ve, ≥2 cases | 2.952941176 |
| SEQ ID 498 | 6 | 74517372 | 74531383 | 14011 | gain | 1894 | CD109 | Exon+ve, ≥2 cases | 2.952941176 |
| SEQ ID 499 | 19 | 57718358 | 57733017 | 14659 | loss | 1678 | ZNF808 | Exon+ve, ≥2 cases | 2.952941176 |
| SEQ ID 499 | 19 | 57718358 | 57733017 | 14659 | loss | 1855 | ZNF808 | Exon+ve, ≥2 cases | 2.952941176 |
| SEQ ID 500 | 5 | 128316373 | 128331270 | 14907 | loss | 1248 | SLC27A6 | Exon+ve, ≥2 cases | 2.952941176 |
| SEQ ID 501 | 4 | 101572938 | 101587882 | 14944 | gain | 1867 | EMCN | Exon+ve, ≥2 cases | 2.952941176 |
| SEQ ID 502 | 6 | 155530613 | 155545570 | 14957 | loss | 1347 | TIAM2 | Exon+ve, ≥2 cases | 2.952941176 |
| SEQ ID 502 | 6 | 155530613 | 155545570 | 14957 | loss | 1598 | TIAM2 | Exon+ve, ≥2 cases | 2.952941176 |
| SEQ ID 503 | 7 | 100967884 | 100982939 | 15055 | loss | 1820 | EMID2 | Exon+ve, ≥2 cases | 2.952941176 |
| SEQ ID 504 | 4 | 101572411 | 101587882 | 15471 | gain | 1752 | EMCN | Exon+ve, ≥2 cases | 2.952941176 |
| SEQ ID 505 | 20 | 52074911 | 52090393 | 15482 | loss | 1354 | BCAS1 | Exon+ve, ≥2 cases | 2.952941176 |
| SEQ ID 505 | 20 | 52074911 | 52090393 | 15482 | loss | 1860 | BCAS1 | Exon+ve, ≥2 cases | 2.952941176 |
| SEQ ID 506 | 9 | 127014097 | 127029947 | 15850 | loss | 1222 | RABEPK | Exon+ve, ≥2 cases | 2.952941176 |
| SEQ ID 507 | 16 | 86347096 | 86364664 | 17568 | loss | 2041 | KLHDC4 | Exon+ve, distinct CNVs, same Gene | 2.952941176 |
| SEQ ID 508 | 17 | 72982885 | 73000459 | 17574 | loss | 1909 | SEPT9 | Exon+ve, ≥2 cases | 2.952941176 |
| SEQ ID 509 | 12 | 51132302 | 51150231 | 17929 | loss | 1844 | KRT6C | Exon+ve, ≥2 cases | 2.952941176 |
| SEQ ID 509 | 12 | 51132302 | 51150231 | 17929 | loss | 2037 | KRT6C | Exon+ve, ≥2 cases | 2.952941176 |
| SEQ ID 510 | 7 | 107049716 | 107067706 | 17990 | loss | 1321 | BCAP29 | Exon+ve, ≥2 cases | 2.952941176 |
| SEQ ID 510 | 7 | 107049716 | 107067706 | 17990 | loss | 1475 | BCAP29 | Exon+ve, ≥2 cases | 2.952941176 |
| SEQ ID 511 | 11 | 65842722 | 65860867 | 18145 | loss | 1958 | RIN1 | Exon+ve, ≥2 cases | 2.952941176 |
| SEQ ID 512 | 3 | 38415026 | 38433483 | 18457 | loss | 1725 | XYLB | Exon+ve, ≥2 cases | 2.952941176 |
| SEQ ID 513 | 16 | 86307080 | 86326794 | 19714 | loss | 1258 | KLHDC4 | Exon+ve, distinct CNVs, same Gene | 2.952941176 |
| SEQ ID 514 | 1 | 233582552 | 233602295 | 19743 | loss | 1720 | TBCE | Exon+ve, ≥2 cases | 2.952941176 |
| SEQ ID 515 | 7 | 91585706 | 91605955 | 20249 | loss | 1856 | CYP51A1 | Exon+ve, ≥2 cases | 2.952941176 |
| SEQ ID 516 | 5 | 150504105 | 150524435 | 20330 | loss | 1942 | ANXA6 | Exon+ve, ≥2 cases | 2.952941176 |
| SEQ ID 517 | 9 | 92596909 | 92617806 | 20897 | gain | 1423 | SYK | Exon+ve, distinct CNVs, same Gene | 2.952941176 |
| SEQ ID 518 | 6 | 170680224 | 170701779 | 21555 | gain | 1954 | PSMB1 | Exon+ve, ≥2 cases | 2.952941176 |
| SEQ ID 519 | 9 | 134924325 | 134946471 | 22146 | gain | 1887 | CEL | Exon+ve, ≥2 cases | 2.952941176 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 520 | 11 | 110853365 | 110875598 | 22233 | loss | 1276 | BTG4 | Exon+ve, ≥2 cases | 2.952941176 |
| SEQ ID 521 | 3 | 197537870 | 197560934 | 23064 | gain | 1775 | TM4SF19, TM4SF19-TCTEX1D2 | Exon+ve, ≥2 cases | 2.952941176 |
| SEQ ID 522 | 1 | 149941641 | 149964885 | 23244 | loss | 2033 | CELF3, RIIAD1 | Exon+ve, ≥2 cases | 2.952941176 |
| SEQ ID 523 | 1 | 206053098 | 206076352 | 23254 | loss | 1638 | LOC148696 | Exon+ve, ≥2 cases | 2.952941176 |
| SEQ ID 524 | 17 | 423068 | 446585 | 23517 | loss | 1268 | VPS53 | Exon+ve, ≥2 cases | 2.952941176 |
| SEQ ID 525 | 9 | 6555187 | 6578755 | 23568 | loss | 1609 | GLDC | Exon+ve, distinct CNVs, same Gene | 2.952941176 |
| SEQ ID 526 | 3 | 197712985 | 197736785 | 23800 | loss | 1546 | RNF168, C3orf43 | Exon+ve, ≥2 cases | 2.952941176 |
| SEQ ID 527 | 2 | 48603879 | 48627703 | 23824 | gain | 1276 | STON1-GTF2A1L, STON1 | Exon+ve, distinct CNVs, same Gene | 2.952941176 |
| SEQ ID 528 | 1 | 246138090 | 246162296 | 24206 | gain | 1798 | OR2T8 | Exon+ve, ≥2 cases | 2.952941176 |
| SEQ ID 529 | X | 32203770 | 32228244 | 24474 | gain | 2018 | DMD | Exon+ve, ≥2 cases | 2.952941176 |
| SEQ ID 530 | 1 | 206054159 | 206078819 | 24660 | loss | 1659 | LOC148696 | Exon+ve, ≥2 cases | 2.952941176 |
| SEQ ID 531 | 22 | 24624566 | 24649785 | 25219 | loss | 1833 | MIR1302-1, MYO18B | Exon+ve, ≥2 cases | 2.952941176 |
| SEQ ID 532 | 2 | 125058391 | 125084599 | 26208 | gain | 1803 | CNTNAP5 | Exon+ve, ≥2 cases | 2.952941176 |
| SEQ ID 533 | X | 8931895 | 8958319 | 26424 | loss | 1496 | FAM9B | Exon+ve, ≥2 cases | 2.952941176 |
| SEQ ID 534 | X | 48688957 | 48716140 | 27183 | loss | 1639 | KCND1, OTUD5, GRIPAP1 | Exon+ve, ≥2 cases | 2.952941176 |
| SEQ ID 535 | 2 | 143888582 | 143915868 | 27286 | gain | 1750 | ARHGAP15 | Exon+ve, ≥2 cases | 2.952941176 |
| SEQ ID 536 | 9 | 26919782 | 26947140 | 27358 | loss | 1656 | PLAA, IFT74 | Exon+ve, ≥2 cases | 2.952941176 |
| SEQ ID 537 | 9 | 127001024 | 127028444 | 27420 | loss | 1669 | RABEPK | Exon+ve, ≥2 cases | 2.952941176 |
| SEQ ID 538 | 7 | 89824673 | 89852155 | 27482 | gain | 1864 | GTPBP10 | Exon+ve, distinct CNVs, same Gene | 2.952941176 |
| SEQ ID 539 | 4 | 70523201 | 70551081 | 27880 | loss | 1285 | UGT2A2, UGT2A1 | Exon+ve, ≥2 cases | 2.952941176 |
| SEQ ID 539 | 4 | 70523201 | 70551081 | 27880 | loss | 1433 | UGT2A2, UGT2A1 | Exon+ve, ≥2 cases | 2.952941176 |
| SEQ ID 540 | 2 | 125058391 | 125088012 | 29621 | gain | 1532 | CNTNAP5 | Exon+ve, ≥2 cases | 2.952941176 |
| SEQ ID 541 | 6 | 30021908 | 30052053 | 30145 | loss | 1244 | HCG9 | Exon+ve, ≥2 cases | 2.952941176 |
| SEQ ID 542 | 6 | 26539830 | 26571434 | 31604 | loss | 1968 | BTN2A1, BTN3A3 | Exon+ve, ≥2 cases | 2.952941176 |
| SEQ ID 543 | 17 | 72976383 | 73008700 | 32317 | loss | 1825 | SEPT9 | Exon+ve, ≥2 cases | 2.952941176 |
| SEQ ID 544 | 22 | 34940309 | 34973305 | 32996 | loss | 1724 | APOL2 | Exon+ve, ≥2 cases | 2.952941176 |
| SEQ ID 544 | 22 | 34940309 | 34973305 | 32996 | loss | 2035 | APOL2 | Exon+ve, ≥2 cases | 2.952941176 |
| SEQ ID 545 | 22 | 22324940 | 22358386 | 33446 | loss | 1549 | LOC91316 | Exon+ve, distinct CNVs, same Gene | 2.952941176 |
| SEQ ID 546 | 2 | 179804969 | 179838443 | 33474 | loss | 1425 | SESTD1 | Exon+ve, ≥2 cases | 2.952941176 |
| SEQ ID 547 | X | 154395845 | 154429912 | 34067 | gain | 1724 | TMLHE | Exon+ve, ≥2 cases | 2.952941176 |
| SEQ ID 548 | 16 | 88355436 | 88389622 | 34186 | loss | 1274 | FANCA | Exon+ve, distinct CNVs, same Gene | 2.952941176 |
| SEQ ID 549 | 6 | 26536902 | 26571434 | 34532 | gain | 1842 | BTN2A3, BTN2A1, BTN3A3 | Exon+ve, ≥2 cases | 2.952941176 |
| SEQ ID 550 | 7 | 133872990 | 133908027 | 35037 | gain | 1494 | AKR1B10, AKR1B15 | Exon+ve, ≥2 cases | 2.952941176 |
| SEQ ID 551 | 7 | 127640643 | 127675911 | 35268 | gain | 1733 | LEP | Exon+ve, ≥2 cases | 2.952941176 |
| SEQ ID 552 | 6 | 30021908 | 30057524 | 35616 | loss | 1488 | HCG9 | Exon+ve, ≥2 cases | 2.952941176 |
| SEQ ID 553 | 7 | 127640643 | 127678165 | 37522 | gain | 1266 | LEP | Exon+ve, ≥2 cases | 2.952941176 |
| SEQ ID 554 | 10 | 44921903 | 44960469 | 38566 | gain | 1295 | LOC100133308 | Exon+ve, ≥2 cases | 2.952941176 |
| SEQ ID 555 | 7 | 141408013 | 141446728 | 38715 | gain | 1225 | MGAM | Exon+ve, ≥2 cases | 2.952941176 |
| SEQ ID 555 | 7 | 141408013 | 141446728 | 38715 | gain | 1720 | MGAM | Exon+ve, ≥2 cases | 2.952941176 |
| SEQ ID 556 | 2 | 31279154 | 31321453 | 42299 | loss | 1544 | CAPN14, EHD3 | Exon+ve, ≥2 cases | 2.952941176 |
| SEQ ID 556 | 2 | 31279154 | 31321453 | 42299 | loss | 1929 | CAPN14, EHD3 | Exon+ve, ≥2 cases | 2.952941176 |
| SEQ ID 557 | 11 | 22175296 | 22218868 | 43572 | gain | 1609 | ANO5 | Exon+ve, ≥2 cases | 2.952941176 |
| SEQ ID 558 | 9 | 115858589 | 115903754 | 45165 | gain | 1406 | ZNF618, AMBP, KIF12 | Exon+ve, ≥2 cases | 2.952941176 |
| SEQ ID 558 | 9 | 115858589 | 115903754 | 45165 | gain | 2020 | ZNF618, AMBP, KIF12 | Exon+ve, ≥2 cases | 2.952941176 |
| SEQ ID 559 | 4 | 100955189 | 101000511 | 45322 | gain | 1462 | DAPP1 | Exon+ve, ≥2 cases | 2.952941176 |
| SEQ ID 559 | 4 | 100955189 | 101000511 | 45322 | gain | 1913 | DAPP1 | Exon+ve, ≥2 cases | 2.952941176 |
| SEQ ID 560 | 15 | 80318994 | 80364988 | 45994 | gain | 1740 | EFTUD1, FAM154B | Exon+ve, ≥2 cases | 2.952941176 |
| SEQ ID 561 | 2 | 44403707 | 44458771 | 55064 | loss | 1504 | CAMKMT, PREPL | Exon+ve, ≥2 cases | 2.952941176 |
| SEQ ID 562 | 2 | 99109502 | 99165006 | 55504 | gain | 1466 | TSGA10, C2orf15, MRPL30, MITD1, LIPT1 | Exon+ve, ≥2 cases | 2.952941176 |
| SEQ ID 563 | 14 | 47289928 | 47346649 | 56721 | loss | 1570 | MIR548Y | Exon+ve, ≥2 cases | 2.952941176 |
| SEQ ID 564 | 1 | 16520503 | 16578594 | 58091 | gain | 1995 | C1orf144, FBXO42 | Exon+ve, distinct CNVs, same Gene | 2.952941176 |
| SEQ ID 565 | 12 | 50517950 | 50577179 | 59229 | gain | 1768 | ANKRD33 | Exon+ve, ≥2 cases | 2.952941176 |
| SEQ ID 566 | 14 | 77935509 | 77995126 | 59617 | loss | 1908 | NRXN3 | Exon+ve, distinct CNVs, same Gene | 2.952941176 |
| SEQ ID 567 | 12 | 50517950 | 50578347 | 60397 | gain | 1836 | ANKRD33 | Exon+ve, ≥2 cases | 2.952941176 |
| SEQ ID 568 | 2 | 143887281 | 143956453 | 69172 | loss | 1677 | ARHGAP15 | Exon+ve, ≥2 cases | 2.952941176 |
| SEQ ID 569 | 16 | 31472312 | 31542172 | 69860 | gain | 1618 | CSDAP1 | Exon+ve, ≥2 cases | 2.952941176 |
| SEQ ID 570 | 2 | 201740139 | 201811330 | 71191 | gain | 1943 | CASP10, CFLAR, CASP8 | Exon+ve, ≥2 cases | 2.952941176 |
| SEQ ID 571 | 8 | 10658422 | 10732498 | 74076 | loss | 1663 | PINX1, MIR1322 | Exon+ve, ≥2 cases | 2.952941176 |
| SEQ ID 572 | X | 154297852 | 154375564 | 77712 | gain | 1831 | F8A1, F8A3, F8A2, H2AFB3, H2AFB2, H2AFB1, MIR1184-1, MIR1184-2, MIR1184-3, TMLHE | Exon+ve, ≥2 cases | 2.952941176 |
| SEQ ID 573 | 9 | 92658019 | 92739799 | 81780 | gain | 1626 | SYK | Exon+ve, distinct CNVs, same Gene | 2.952941176 |
| SEQ ID 574 | 8 | 10649592 | 10741416 | 91824 | gain | 2042 | PINX1, MIR1322 | Exon+ve, ≥2 cases | 2.952941176 |
| SEQ ID 575 | 1 | 65696044 | 65796708 | 100664 | gain | 1252 | LEPR | Exon+ve, ≥2 cases | 2.952941176 |
| SEQ ID 576 | 9 | 118469713 | 118571048 | 101335 | loss | 1559 | ASTN2, TRIM32 | Exon+ve, ≥2 cases | 2.952941176 |
| SEQ ID 577 | 4 | 99278436 | 99382350 | 103914 | loss | 1534 | C4orf37 | Exon+ve, distinct CNVs, same Gene | 2.952941176 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 578 | 14 | 47273858 | 47378183 | 104325 | gain | 1709 | MIR548Y | Exon+ve, ≥2 cases | 2.952941176 |
| SEQ ID 579 | 20 | 26052035 | 26156944 | 104909 | gain | 1793 | MIR663 | Exon+ve, ≥2 cases | 2.952941176 |
| SEQ ID 580 | 1 | 65696044 | 65802848 | 106804 | gain | 1920 | LEPR | Exon+ve, ≥2 cases | 2.952941176 |
| SEQ ID 581 | 9 | 118405993 | 118524253 | 118260 | loss | 1622 | ASTN2, TRIM32 | Exon+ve, ≥2 cases | 2.952941176 |
| SEQ ID 582 | 16 | 81373761 | 81503479 | 129718 | loss | 1824 | CDH13 | Exon+ve, ≥2 cases | 2.952941176 |
| SEQ ID 583 | 12 | 110666479 | 110799506 | 133027 | gain | 2022 | ACAD10, MAPKAPK5, C12orf47, ALDH2 | Exon+ve, ≥2 cases | 2.952941176 |
| SEQ ID 584 | 12 | 110665203 | 110799506 | 134303 | gain | 1763 | ACAD10, MAPKAPK5, C12orf47, ALDH2 | Exon+ve, ≥2 cases | 2.952941176 |
| SEQ ID 585 | 10 | 118141035 | 118275679 | 134644 | gain | 2036 | PNLIPRP3 | Exon+ve, ≥2 cases | 2.952941176 |
| SEQ ID 586 | 11 | 51235737 | 51371826 | 136089 | gain | 1708 | OR4C46, OR4A5 | Exon+ve, ≥2 cases | 2.952941176 |
| SEQ ID 587 | 6 | 170616733 | 170753106 | 136373 | gain | 1729 | TBP, PDCD2, PSMB1 | Exon+ve, ≥2 cases | 2.952941176 |
| SEQ ID 588 | 16 | 68710277 | 68850394 | 140117 | loss | 1538 | LOC729513, PDPR, AARS, EXOSC6, CLEC18C | Exon+ve, ≥2 cases | 2.952941176 |
| SEQ ID 589 | 15 | 80222009 | 80364988 | 142979 | gain | 1354 | EFTUD1, FAM154B | Exon+ve, ≥2 cases | 2.952941176 |
| SEQ ID 590 | 1 | 199054239 | 199199515 | 145276 | gain | 1587 | CAMSAP1L1, C1orf106, GPR25 | Exon+ve, ≥2 cases | 2.952941176 |
| SEQ ID 590 | 1 | 199054239 | 199199515 | 145276 | gain | 1799 | CAMSAP1L1, C1orf106, GPR25 | Exon+ve, ≥2 cases | 2.952941176 |
| SEQ ID 591 | 1 | 246025834 | 246172497 | 146663 | gain | 2034 | OR2L13, OR11L1, TRIM58, OR2T8, OR14A16, OR2W3 | Exon+ve, ≥2 cases | 2.952941176 |
| SEQ ID 592 | 16 | 68710277 | 68859920 | 149643 | loss | 1793 | LOC729513, PDPR, AARS, EXOSC6, CLEC18C | Exon+ve, ≥2 cases | 2.952941176 |
| SEQ ID 593 | 19 | 20619921 | 20779347 | 159426 | gain | 1566 | ZNF626 | Exon+ve, ≥2 cases | 2.952941176 |
| SEQ ID 593 | 19 | 20619921 | 20779347 | 159426 | gain | 1761 | ZNF626 | Exon+ve, ≥2 cases | 2.952941176 |
| SEQ ID 594 | 3 | 59891946 | 60074208 | 182262 | loss | 1991 | FHIT | Exon+ve, ≥2 cases | 2.952941176 |
| SEQ ID 595 | 7 | 89622481 | 89820179 | 197698 | gain | 1274 | STEAP1, GTPBP10, STEAP2, C7orf63 | Exon+ve, distinct CNVs, same Gene | 2.952941176 |
| SEQ ID 596 | 8 | 6718944 | 6926661 | 207717 | gain | 1572 | DEFB1, DEFA10P, DEFT1P2, DEFA6, DEFA5, DEFA4, DEFA3, DEFA1, DEFA1B, DEFT1P | Exon+ve, ≥2 cases | 2.952941176 |
| SEQ ID 597 | 9 | 134914697 | 135122604 | 207907 | loss | 1321 | GBGT1, RALGDS, OBP2B, CEL, CELP, ABO, GTF3C5 | Exon+ve, ≥2 cases | 2.952941176 |
| SEQ ID 598 | 19 | 63483128 | 63704294 | 221166 | gain | 1862 | ZNF324B, ZNF446, LOC646862, ZNF324, ZNF8, ZNF497, RPS5, ZNF584, ZNF837, SLC27A5, ZNF132, A1BG-AS1, ZSCAN22, A1BG | Exon+ve, ≥2 cases | 2.952941176 |
| SEQ ID 599 | 4 | 74035932 | 74268619 | 232687 | gain | 1347 | COX18, ANKRD17 | Exon+ve, ≥2 cases | 2.952941176 |
| SEQ ID 599 | 4 | 74035932 | 74268619 | 232687 | gain | 1945 | COX18, ANKRD17 | Exon+ve, ≥2 cases | 2.952941176 |
| SEQ ID 600 | 5 | 37174246 | 37411545 | 237299 | gain | 1765 | NUP155, C5orf42 | Exon+ve, ≥2 cases | 2.952941176 |
| SEQ ID 601 | 17 | 365082 | 612187 | 247105 | gain | 1494 | VPS53, DBIL5P, FAM57A, GEMIN4, GLOD4 | Exon+ve, ≥2 cases | 2.952941176 |
| SEQ ID 602 | 1 | 61661443 | 61911592 | 250149 | gain | 1828 | NFIA | Exon+ve, distinct CNVs, same Gene | 2.952941176 |
| SEQ ID 603 | 1 | 233499409 | 233769452 | 270043 | gain | 1466 | B3GALNT2, ARID4B, TBCE, GGPS1 | Exon+ve, ≥2 cases | 2.952941176 |
| SEQ ID 604 | 14 | 79195482 | 79484792 | 289310 | loss | 2036 | NRXN3 | Exon+ve, distinct CNVs, same Gene | 2.952941176 |
| SEQ ID 605 | 6 | 165458835 | 165766046 | 307211 | gain | 1760 | C6orf118, PDE10A | Exon+ve, ≥2 cases | 2.952941176 |
| SEQ ID 606 | 8 | 6489869 | 6814347 | 324478 | loss | 1621 | XKR5, DEFB1, DEFA10P, DEFA6, AGPAT5, DEFA4 | Exon+ve, ≥2 cases | 2.952941176 |
| SEQ ID 607 | 4 | 186649665 | 186977002 | 327337 | gain | 1281 | SORBS2, PDLIM3 | Exon+ve, ≥2 cases | 2.952941176 |
| SEQ ID 608 | 3 | 76072 | 406838 | 330766 | gain | 1598 | CHL1 | Exon+ve, ≥2 cases | 2.952941176 |
| SEQ ID 609 | 19 | 47894889 | 48276273 | 381384 | gain | 1282 | PSG11, LOC100289650, PSG10P, PSG8, PSG6, PSG7, PSG2, PSG3, PSG1 | Exon+ve, ≥2 cases | 2.952941176 |
| SEQ ID 610 | 19 | 47894889 | 48279312 | 384423 | gain | 1281 | PSG11, LOC100289650, PSG10P, PSG8, PSG6, PSG7, PSG2, PSG3, PSG1 | Exon+ve, ≥2 cases | 2.952941176 |
| SEQ ID 611 | X | 32949940 | 33336759 | 386819 | gain | 1864 | DMD | Exon+ve, ≥2 cases | 2.952941176 |
| SEQ ID 612 | 5 | 13846827 | 14235806 | 388979 | gain | 1282 | TRIO, DNAH5 | Exon+ve, distinct CNVs, same Gene | 2.952941176 |
| SEQ ID 613 | 11 | 125616034 | 126095587 | 479553 | gain | 1713 | DCPS, SRPR, FLJ39051, TIRAP, FAM118B, FOXRED1, ST3GAL4, KIRREL3 | Exon+ve, ≥2 cases | 2.952941176 |
| SEQ ID 614 | 7 | 91113310 | 91618147 | 504837 | loss | 1734 | MTERF, LOC401387, AKAP9, CYP51A1 | Exon+ve, ≥2 cases | 2.952941176 |
| SEQ ID 615 | 10 | 44921903 | 45476905 | 555002 | gain | 1968 | ANUBL1, ALOX5, LOC338579, LOC100133308, MIR3156-1, OR13A1, MARCH8 | Exon+ve, ≥2 cases | 2.952941176 |
| SEQ ID 616 | 3 | 197412253 | 197977900 | 565647 | gain | 1565 | PCYT1A, FBXO45, C3orf34, LRRC33, WDR53, TM4SF19-TCTEX1D2, RNF168, ZDHHC19, OSTalpha, C3orf43, TM4SF19, PIGX, TCTEX1D2, UBXN7, PAK2 | Exon+ve, ≥2 cases | 2.952941176 |
| SEQ ID 617 | 4 | 188688388 | 189297555 | 609167 | gain | 1704 | ZFP42, TRIML2, TRIML1 | Exon+ve, ≥2 cases | 2.952941176 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 618 | 2 | 99091835 | 99871538 | 779703 | gain | 1461 | MRPL30, LYG2, LIPT1, AFF3, MITD1, TXNDC9, TSGA10, C2orf15, REV1, EIF5B, LYG1 | Exon+ve, ≥2 cases | 2.952941176 |
| SEQ ID 619 | 3 | 59354708 | 60181047 | 826339 | gain | 1936 | FHIT | Exon+ve, ≥2 cases | 2.952941176 |
| SEQ ID 620 | 7 | 47938912 | 48966480 | 1027568 | loss | 1886 | UPP1, ABCA13, PKD1L1, HUS1, CDC14C, C7orf57, SUN3 | Exon+ve, ≥2 cases | 2.952941176 |
| SEQ ID 621 | 1 | 60432403 | 61460047 | 1027644 | gain | 1396 | NFIA | Exon+ve, distinct CNVs, same Gene | 2.952941176 |
| SEQ ID 622 | 10 | 45478103 | 46558272 | 1080169 | gain | 1653 | LOC643650, ANUBL1, GPRIN2, PTPN20B, PTPN20A, FAM35B, LOC728643, FRMPD2P1, AGAP4, SYT15, BMS1P1, FAM21C, BMS1P5, PPYR1 | Exon+ve, ≥2 cases | 2.952941176 |
| SEQ ID 623 | 1 | 97323730 | 98426121 | 1102391 | loss | 1454 | MIR137, DPYD | Exon+ve, ≥2 cases | 2.952941176 |
| SEQ ID 624 | 3 | 227364 | 1488979 | 1261615 | gain | 1657 | CHL1, CNTN6 | Exon+ve, ≥2 cases | 2.952941176 |
| SEQ ID 625 | 15 | 26805834 | 28154955 | 1349121 | loss | 1994 | LOC100289656, TJP1, APBA2, NDNL2, LOC646278, FAM189A1 | Exon+ve, ≥2 cases | 2.952941176 |
| SEQ ID 626 | 16 | 80725035 | 82228276 | 1503241 | gain | 1875 | CDH13, MIR3182, MPHOSPH6 | Exon+ve, ≥2 cases | 2.952941176 |
| SEQ ID 627 | 10 | 45478103 | 47017598 | 1539495 | gain | 1408 | GPRIN2, LOC643650, PTPN20B, PTPN20A, FAM35B, FAM21C, SYT15, FAM25C, LOC728643, FAM25G, LOC642826, ANXA8, FAM35B2, ANXA8L1, FRMPD2P1, AGAP4, FAM25B, BMS1P1, AGAP9, BMS1P5, PPYR1, ANUBL1 | Exon+ve, ≥2 cases | 2.952941176 |
| SEQ ID 628 | 15 | 26805834 | 28439781 | 1633947 | gain | 1988 | LOC100289656, TJP1, APBA2, FAM7A1, LOC653075, DKFZP434L187, FAM7A2, FAM7A3, NDNL2, LOC646278, FAM189A1 | Exon+ve, ≥2 cases | 2.952941176 |
| SEQ ID 629 | 1 | 242999910 | 244841528 | 1841618 | loss | 1767 | CNST, TFB2M, HNRNPU, KIF26B, NCRNA00201, FAM36A, SMYD3, EFCAB2 | Exon+ve, ≥2 cases | 2.952941176 |
| SEQ ID 630 | 4 | 188089090 | 190030740 | 1941650 | gain | 1691 | LOC401164, ZFP42, TRIML2, TRIML1 | Exon+ve, ≥2 cases | 2.952941176 |
| SEQ ID 631 | 20 | 26080750 | 28252024 | 2171274 | gain | 1694 | MIR663, FRG1B | Exon+ve, ≥2 cases | 2.952941176 |
| SEQ ID 632 | 11 | 51235737 | 54785063 | 3549326 | gain | 1943 | OR4C46, OR4A5 | Exon+ve, ≥2 cases | 2.952941176 |
| SEQ ID 633 | X | 48171740 | 52710629 | 4538889 | gain | 1349 | SSX7, SSX8, ERAS, PPP1R3F, GAGE1, WAS, XAGE2B, GAGE5, GAGE4, CACNA1F, GAGE6, GATA1, NUDT10, SLC38A5, TFE3, PORCN, GAGE2D, GAGE2E, GAGE2A, GAGE2B, GAGE2C, GAGE12J, MAGIX, AKAP4, MAGED1, MAGED4, PQBP1, LOC347376, FOXP3, XAGE1D, PAGE4, PAGE1, WDR45, CCDC120, FTSJ1, SYP, TBC1D25, MIR532, GSPT2, GAGE8, GLOD5, XAGE2, HDAC6, OTUD5, PRAF2, SHROOM4, PLP2, GPKOW, MIR500A, MIR500B, LOC158572, CENPVL1, LOC441495, MIR188, GAGE12H, GAGE12I, MIR660, GRIPAP1, GAGE12B, GAGE12C, GAGE12D, GAGE12E, GAGE12F, GAGE12G, MIR502, MIR501, WDR13, RBM3, CCDC22, BMP15, TIMM17B, PRICKLE3, DGKK, KCND1, XAGE1A, XAGE1B, XAGE1C, PIM2, XAGE1E, SUV39H1, USP27X, SLC35A2, CLCN5, GAGE7, CCNB3, MIR362, PCSK1N, SNORA11E, SNORA11D, GAGE10, GAGE13, NUDT11, EBP, MAGED4B | Exon+ve, ≥2 cases | 2.952941176 |
| SEQ ID 634 | 19 | 62653275 | 62660645 | 7370 | loss | 1522 | VN1R1 | Exon+ve, ≥2 cases | 1.474302496 |
| SEQ ID 635 | 15 | 56031543 | 56044966 | 13423 | loss | 1680 | ALDH1A2 | Exon+ve, distinct | 1.474302496 |

TABLE 1-continued

| SEQ ID No | Chr | Orig CNV Start | Orig CNV Stop | Orig CNV Size | CNV type | ASD Case ID(s) | RefSeq Gene Symbol(s) | Category | OR |
|---|---|---|---|---|---|---|---|---|---|
| SEQ ID 636 | 11 | 99646264 | 99660303 | 14039 | loss | 1936 | CNTN5 | CNVs, same Gene Special | 1.474302496 |
| SEQ ID 637 | 11 | 70167828 | 70217957 | 50129 | loss | 1835 | SHANK2 | Special | 1.474302496 |
| SEQ ID 638 | X | 151730135 | 151853605 | 123470 | gain | 1887 | ZNF185, CETN2, NSDHL | Exon+ve, ≥2 cases | 1.474302496 |
| SEQ ID 639 | 2 | 50421622 | 50908053 | 486431 | loss | 1597 | NRXN1 | Exon+ve, distinct CNVs, same Gene | 1.474302496 |
| SEQ ID 640 | 3 | 2389001 | 2955718 | 566717 | gain | 1851 | CNTN4 | Special | 1.474302496 |
| SEQ ID 641 | 1 | 244191230 | 244851275 | 660045 | gain | 1819 | TFB2M, CNST, SMYD3 | Exon+ve, ≥2 cases | 1.474302496 |
| SEQ ID 642 | X | 96492941 | 97405356 | 912415 | gain | 1348 | DIAPH2 | Exon+ve, ≥2 cases | 1.474302496 |
| SEQ ID 643 | 17 | 26847029 | 26870510 | 23481 | loss | 1411 | RAB11FIP4 | Special | 1.474302496 |

* Position references refer to the human genomic sequence Hg18 March 2006 (NCBI Build 36.1)

Table 1 lists all CNVs of interest, obtained as described in the text. For each entry, the originating CNV start and stop positions are noted, along with CNV size, CNV type (loss or gain), gene annotation (for original CNV), category of interest, and Odds Ratio (OR). The table also includes SEQ IDs for the CNVs in the range SEQ ID 1-SEQ ID 643. CNVs that are identical between different ASD subjects are grouped into a single SEQ ID. Each SEQ ID refers to a numbered sequence in file 33655-708.202_PDx_SK_ST25.txt. "De novo" refers to CNVs found to occur in the offspring of two parents, neither of whom has the relevant CNV; "Intronic" refers to CNV subregions affecting introns only; "Ctrl pos High OR" refers to CNVs which include regions present at high frequency in the ASD cohort cf. normal cohort; "Exon+ve, distinct CNVs, same Gene" refers to CNVs in 2 or more ASD individuals affecting different exons of the same gene; "Exon+ve,≥2 cases" refers to CNVs in 2 or more ASD individuals affecting the same exon of a gene; "Special" refers to CNVs added to the list because of relationship to genes with strong biological evidence in ASD; "OR" refers to the odds ratio calculation for the candidate CNV. The OR is calculated by grouping together all cases with an identical CNV/CNV subregion, and comparing it to the frequency of the same CNV/CNV subregion in the normal cohort. The calculation is performed as follows: (ASD A/682-ASD A)/(NVE A/1,005-NVE A), where ASD A=number of ASD cases with the CNV and NVE A=number of normals with the CNV. In those cases for which no normals possess the CNV of interest, NVE A is set to 1 by convention. For example, the OR calculation for the MAOA Intronic CNV is as follows: OR=(26/682−26)/(1/1005−1)=(26/656)/(1/1004)=39.79268293.

Column 3 refers to the nucleotide position in the respective chromosome (column 2) where the corresponding CNV begins and column 4 refers to the nucleotide position in the respective chromosome where the corresponding CNV ends. Column 5 refers to the length/size of the CNV in bps. Nucleotide positions were determined using the database Hg18 Mar. 2006 (NCBI Build 36.1). The CNV classifications (column 6) of gain or loss indicate whether each CNV region found in the subjects was duplicated/amplified (gain) or deleted (loss) in the genome.

TABLE 2

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 1 | 1 | 3752549 | 3754045 | 1496 | loss | 1426 | KIAA0562 | Exon+ve, ≥2 cases | Yes |
| 1 | 1 | 3752549 | 3754045 | 1496 | loss | 1439 | KIAA0562 | Exon+ve, ≥2 cases | Yes |
| 1 | 1 | 3752549 | 3754045 | 1496 | loss | 1441 | KIAA0562 | Exon+ve, ≥2 cases | Yes |
| 1 | 1 | 3752549 | 3754045 | 1496 | loss | 1912 | KIAA0562 | Exon+ve, ≥2 cases | Yes |
| 1 | 2 | 16653070 | 16659903 | 6833 | gain | 1995 | C1orf144 | Exon+ve, distinct CNVs, same Gene | Yes |
| 1 | 3 | 16578594 | 16591820 | 13226 | loss | 1315 | C1orf144 | Exon+ve, distinct CNVs, same Gene | Yes |
| 1 | 4 | 19054398 | 19061530 | 7132 | gain | 1502 | TAS1R2 | Exon+ve, ≥2 cases | Yes |
| 1 | 4 | 19054398 | 19061530 | 7132 | gain | 1940 | TAS1R2 | Exon+ve, ≥2 cases | Yes |
| 1 | 5 | 22787161 | 22788440 | 1279 | loss | 1278 | EPHA8 | Exon+ve, ≥2 cases | Yes |
| 1 | 5 | 22787161 | 22788440 | 1279 | loss | 1687 | EPHA8 | Exon+ve, ≥2 cases | Yes |
| 1 | 5 | 22787161 | 22788440 | 1279 | loss | 1895 | EPHA8 | Exon+ve, ≥2 cases | Yes |
| 1 | 6 | 47551915 | 47557441 | 5526 | loss | 1591 | STIL | Exon+ve, ≥2 cases | Yes |
| 1 | 6 | 47551915 | 47557441 | 5526 | loss | 1759 | STIL | Exon+ve, ≥2 cases | Yes |
| 1 | 7 | 61097736 | 61359814 | 262078 | gain | 1396 | NFIA | Exon+ve, distinct CNVs, same Gene | Yes |
| 1 | 8 | 61661443 | 61707075 | 45632 | gain | 1828 | NFIA | Exon+ve, distinct CNVs, same Gene | Yes |
| 1 | 9 | 65729501 | 65793446 | 63945 | gain | 1252 | LEPR | Exon+ve, ≥2 cases | Yes |
| 1 | 9 | 65729501 | 65793446 | 63945 | gain | 1920 | LEPR | Exon+ve, ≥2 cases | Yes |
| 1 | 10 | 85964576 | 85967615 | 3039 | loss | 1266 | COL24A1 | Exon+ve, ≥2 cases | Yes |
| 1 | 10 | 85964576 | 85967615 | 3039 | loss | 1283 | COL24A1 | Exon+ve, ≥2 cases | Yes |
| 1 | 10 | 85964576 | 85967615 | 3039 | loss | 1284 | COL24A1 | Exon+ve, ≥2 cases | Yes |
| 1 | 10 | 85964576 | 85967615 | 3039 | loss | 1308 | COL24A1 | Exon+ve, ≥2 cases | Yes |
| 1 | 10 | 85964576 | 85967615 | 3039 | loss | 1309 | COL24A1 | Exon+ve, ≥2 cases | Yes |
| 1 | 10 | 85964576 | 85967615 | 3039 | loss | 1354 | COL24A1 | Exon+ve, ≥2 cases | Yes |
| 1 | 10 | 85964576 | 85967615 | 3039 | loss | 1413 | COL24A1 | Exon+ve, ≥2 cases | Yes |
| 1 | 10 | 85964576 | 85967615 | 3039 | loss | 1418 | COL24A1 | Exon+ve, ≥2 cases | Yes |
| 1 | 10 | 85964576 | 85967615 | 3039 | loss | 1433 | COL24A1 | Exon+ve, ≥2 cases | Yes |
| 1 | 10 | 85964576 | 85967615 | 3039 | loss | 1449 | COL24A1 | Exon+ve, ≥2 cases | Yes |
| 1 | 10 | 85964576 | 85967615 | 3039 | loss | 1451 | COL24A1 | Exon+ve, ≥2 cases | Yes |
| 1 | 10 | 85964576 | 85967615 | 3039 | loss | 1640 | COL24A1 | Exon+ve, ≥2 cases | Yes |
| 1 | 10 | 85964576 | 85967615 | 3039 | loss | 1781 | COL24A1 | Exon+ve, ≥2 cases | Yes |
| 1 | 10 | 85964576 | 85967615 | 3039 | loss | 1815 | COL24A1 | Exon+ve, ≥2 cases | Yes |
| 1 | 10 | 85964576 | 85967615 | 3039 | loss | 1818 | COL24A1 | Exon+ve, ≥2 cases | Yes |
| 1 | 10 | 85964576 | 85967615 | 3039 | loss | 1929 | COL24A1 | Exon+ve, ≥2 cases | Yes |
| 1 | 10 | 85964576 | 85967615 | 3039 | loss | 1994 | COL24A1 | Exon+ve, ≥2 cases | Yes |
| 1 | 10 | 85964576 | 85967615 | 3039 | loss | 2031 | COL24A1 | Exon+ve, ≥2 cases | Yes |
| 1 | 10 | 85964576 | 85967615 | 3039 | loss | 2040 | COL24A1 | Exon+ve, ≥2 cases | Yes |
| 1 | 11 | 91632025 | 91632374 | 349 | loss | 1582 | HFM1 | Exon+ve, ≥2 cases | Yes |
| 1 | 11 | 91632025 | 91632374 | 349 | loss | 1687 | HFM1 | Exon+ve, ≥2 cases | Yes |
| 1 | 11 | 91632025 | 91632374 | 349 | loss | 1929 | HFM1 | Exon+ve, ≥2 cases | Yes |
| 1 | 11 | 91632025 | 91632374 | 349 | loss | 2045 | HFM1 | Exon+ve, ≥2 cases | Yes |
| 1 | 12 | 91946409 | 91948225 | 1816 | gain | 1405 | TGFBR3 | Exon+ve, ≥2 cases | Yes |
| 1 | 12 | 91946409 | 91948225 | 1816 | loss | 1656 | TGFBR3 | Exon+ve, ≥2 cases | Yes |
| 1 | 12 | 91946409 | 91948225 | 1816 | loss | 2043 | TGFBR3 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 1 | 12 | 93492660 | 93495455 | 2795 | gain | 1832 | CCDC18 | Exon+ve, ≥2 cases | Yes |
| 1 | 12 | 93492660 | 93495455 | 2795 | gain | 2032 | CCDC18 | Exon+ve, ≥2 cases | Yes |
| 1 | 13 | 94113132 | 94115121 | 1989 | loss | 1233 | DNTTIP2 | Exon+ve, ≥2 cases | Yes |
| 1 | 13 | 94113132 | 94115121 | 1989 | loss | 1802 | DNTTIP2 | Exon+ve, ≥2 cases | Yes |
| 1 | 13 | 94113132 | 94115121 | 1989 | loss | 1904 | DNTTIP2 | Exon+ve, ≥2 cases | Yes |
| 1 | 13 | 94115123 | 94116506 | 1383 | loss | 1233 | DNTTIP2 | Exon+ve, ≥2 cases | Yes |
| 1 | 13 | 94115123 | 94116506 | 1383 | loss | 1782 | DNTTIP2 | Exon+ve, ≥2 cases | Yes |
| 1 | 13 | 94115123 | 94116506 | 1383 | loss | 1802 | DNTTIP2 | Exon+ve, ≥2 cases | Yes |
| 1 | 14 | 97937667 | 97947671 | 10004 | loss | 1221 | DPYD | Exon+ve, ≥2 cases | Yes |
| 1 | 14 | 97937667 | 97947671 | 10004 | loss | 1454 | DPYD | Exon+ve, ≥2 cases | Yes |
| 1 | 15 | 110102580 | 110114121 | 11541 | loss | 1680 | EPS8L3 | Exon+ve, ≥2 cases | Yes |
| 1 | 15 | 110102580 | 110114121 | 11541 | loss | 1802 | EPS8L3 | Exon+ve, ≥2 cases | Yes |
| 1 | 16 | 144099302 | 144337286 | 237984 | gain | 1599 | RNF115, RBM8A, GNRHR2, HFE2, ANKRD34A, LIX1L, POLR3GL, ANKRD35, ITGA10, PEX11B, NUDT17, TXNIP, POLR3C, PIAS3 | Exon+ve, ≥2 cases | Yes |
| 1 | 16 | 144099302 | 144337286 | 237984 | loss | 1874 | RNF115, RBM8A, GNRHR2, HFE2, ANKRD34A, LIX1L, POLR3GL, ANKRD35, ITGA10, PEX11B, NUDT17, TXNIP, POLR3C, PIAS3 | Exon+ve, ≥2 cases | Yes |
| 1 | 16 | 144099302 | 144337286 | 237984 | gain | 1968 | RNF115, RBM8A, GNRHR2, HFE2, ANKRD34A, LIX1L, POLR3GL, ANKRD35, ITGA10, PEX11B, NUDT17, TXNIP, POLR3C, PIAS3 | Exon+ve, ≥2 cases | Yes |
| 1 | 17 | 149957941 | 149964885 | 6944 | loss | 1867 | RIIAD1 | Exon+ve, ≥2 cases | Yes |
| 1 | 17 | 149957941 | 149964885 | 6944 | loss | 2033 | RIIAD1 | Exon+ve, ≥2 cases | Yes |
| 1 | 18 | 151040464 | 151045964 | 5500 | gain | 1223 | LCE1C | Exon+ve, ≥2 cases | Yes |
| 1 | 18 | 151040464 | 151045964 | 5500 | gain | 1587 | LCE1C | Exon+ve, ≥2 cases | Yes |
| 1 | 18 | 151040464 | 151045964 | 5500 | gain | 1664 | LCE1C | Exon+ve, ≥2 cases | Yes |
| 1 | 18 | 151040464 | 151045964 | 5500 | gain | 1695 | LCE1C | Exon+ve, ≥2 cases | Yes |
| 1 | 18 | 151040464 | 151045964 | 5500 | gain | 1740 | LCE1C | Exon+ve, ≥2 cases | Yes |
| 1 | 18 | 151040464 | 151045964 | 5500 | gain | 1936 | LCE1C | Exon+ve, ≥2 cases | Yes |
| 1 | 19 | 156784465 | 156785660 | 1195 | loss | 1858 | OR6Y1 | Exon+ve, ≥2 cases | Yes |
| 1 | 19 | 156784465 | 156785660 | 1195 | loss | 1877 | OR6Y1 | Exon+ve, ≥2 cases | Yes |
| 1 | 20 | 177589995 | 177591659 | 1664 | loss | 1372 | SOAT1 | Exon+ve, ≥2 cases | Yes |
| 1 | 20 | 177589995 | 177591659 | 1664 | loss | 1635 | SOAT1 | Exon+ve, ≥2 cases | Yes |
| 1 | 21 | 179250547 | 179263983 | 13436 | loss | 1638 | STX6 | Exon+ve, ≥2 cases | Yes |
| 1 | 21 | 179250547 | 179263983 | 13436 | loss | 1659 | STX6 | Exon+ve, ≥2 cases | Yes |
| 1 | 21 | 179250547 | 179263983 | 13436 | loss | 1662 | STX6 | Exon+ve, ≥2 cases | Yes |
| 1 | 21 | 179250547 | 179263983 | 13436 | loss | 1950 | STX6 | Exon+ve, ≥2 cases | Yes |
| 1 | 22 | 179263984 | 179269450 | 5466 | loss | 1638 | MR1 | Exon+ve, ≥2 cases | Yes |
| 1 | 22 | 179263984 | 179269450 | 5466 | loss | 1659 | MR1 | Exon+ve, ≥2 cases | Yes |
| 1 | 23 | 199054239 | 199082294 | 28055 | gain | 1587 | CAMSAP1L1 | Exon+ve, ≥2 cases | Yes |
| 1 | 23 | 199054239 | 199082294 | 28055 | gain | 1799 | CAMSAP1L1 | Exon+ve, ≥2 cases | Yes |
| 1 | 24 | 199149079 | 199185984 | 36905 | gain | 1587 | C1orf106 | Exon+ve, ≥2 cases | Yes |
| 1 | 24 | 199149079 | 199185984 | 36905 | loss | 1799 | C1orf106 | Exon+ve, ≥2 cases | Yes |
| 1 | 25 | 201194532 | 201202914 | 8382 | loss | 1572 | CYB5R1 | Exon+ve, ≥2 cases | Yes |
| 1 | 25 | 201194532 | 201202914 | 8382 | loss | 1687 | CYB5R1 | Exon+ve, ≥2 cases | Yes |
| 1 | 26 | 206023029 | 206024152 | 1123 | loss | 1724 | CD46 | Exon+ve, ≥2 cases | Yes |
| 1 | 26 | 206023029 | 206024152 | 1123 | loss | 1843 | CD46 | Exon+ve, ≥2 cases | Yes |
| 1 | 27 | 206054159 | 206076352 | 22193 | loss | 1638 | LOC148696 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 1 | 27 | 206054159 | 206076352 | 22193 | loss | 1659 | LOC148696 | Exon+ve, ≥2 cases | Yes |
| 1 | 28 | 226069732 | 226072012 | 2280 | loss | 1234 | PRSS38 | Exon+ve, ≥2 cases | Yes |
| 1 | 28 | 226069732 | 226072012 | 2280 | loss | 1344 | PRSS38 | Exon+ve, ≥2 cases | Yes |
| 1 | 28 | 226069732 | 226072012 | 2280 | loss | 1371 | PRSS38 | Exon+ve, ≥2 cases | Yes |
| 1 | 28 | 226069732 | 226072012 | 2280 | loss | 1653 | PRSS38 | Exon+ve, ≥2 cases | Yes |
| 1 | 29 | 233582552 | 233602295 | 19743 | gain | 1466 | TBCE | Exon+ve, ≥2 cases | Yes |
| 1 | 29 | 233582552 | 233602295 | 19743 | loss | 1720 | TBCE | Exon+ve, ≥2 cases | Yes |
| 1 | 30 | 243768850 | 243777832 | 3982 | loss | 1767 | KIF26B | Exon+ve, ≥2 cases | Yes |
| 1 | 30 | 243768850 | 243777832 | 3982 | loss | 1840 | KIF26B | Exon+ve, ≥2 cases | Yes |
| 1 | 31 | 244768366 | 244771085 | 2719 | loss | 1767 | TFB2M | Exon+ve, ≥2 cases | Yes |
| 1 | 31 | 244768366 | 244771085 | 2719 | gain | 1819 | TFB2M | Exon+ve, ≥2 cases | Yes |
| 1 | 32 | 246138090 | 246162296 | 24206 | gain | 1798 | OR2T8 | Exon+ve, ≥2 cases | Yes |
| 1 | 32 | 246138090 | 246162296 | 24206 | gain | 2034 | OR2T8 | Exon+ve, ≥2 cases | Yes |
| 2 | 33 | 1469952 | 1472562 | 2610 | loss | 1510 | TPO | Exon+ve, ≥2 cases | Yes |
| 2 | 33 | 1469952 | 1472562 | 2610 | loss | 1564 | TPO | Exon+ve, ≥2 cases | Yes |
| 2 | 33 | 1469952 | 1472562 | 2610 | loss | 1639 | TPO | Exon+ve, ≥2 cases | Yes |
| 2 | 34 | 10263146 | 10272210 | 9064 | loss | 1256 | C2orf48 | Exon+ve, ≥2 cases | Yes |
| 2 | 34 | 10263146 | 10272210 | 9064 | loss | 1285 | C2orf48 | Exon+ve, ≥2 cases | Yes |
| 2 | 34 | 10263146 | 10272210 | 9064 | loss | 1307 | C2orf48 | Exon+ve, ≥2 cases | Yes |
| 2 | 34 | 10263146 | 10272210 | 9064 | loss | 1370 | C2orf48 | Exon+ve, ≥2 cases | Yes |
| 2 | 34 | 10263146 | 10272210 | 9064 | loss | 1396 | C2orf48 | Exon+ve, ≥2 cases | Yes |
| 2 | 34 | 10263146 | 10272210 | 9064 | loss | 1415 | C2orf48 | Exon+ve, ≥2 cases | Yes |
| 2 | 34 | 10263146 | 10272210 | 9064 | loss | 1616 | C2orf48 | Exon+ve, ≥2 cases | Yes |
| 2 | 34 | 10263146 | 10272210 | 9064 | loss | 1654 | C2orf48 | Exon+ve, ≥2 cases | Yes |
| 2 | 34 | 10263146 | 10272210 | 9064 | loss | 1830 | C2orf48 | Exon+ve, ≥2 cases | Yes |
| 2 | 34 | 10263146 | 10272210 | 9064 | loss | 1931 | C2orf48 | Exon+ve, ≥2 cases | Yes |
| 2 | 35 | 30306530 | 30308506 | 1976 | loss | 1429 | LBH | Exon+ve, ≥2 cases | Yes |
| 2 | 35 | 30306530 | 30308506 | 1976 | loss | 1884 | LBH | Exon+ve, ≥2 cases | Yes |
| 2 | 36 | 31279154 | 31321453 | 42299 | loss | 1544 | CAPN14, EHD3 | Exon+ve, ≥2 cases | Yes |
| 2 | 36 | 31279154 | 31321453 | 42299 | loss | 1929 | CAPN14, EHD3 | Exon+ve, ≥2 cases | Yes |
| 2 | 37 | 43857496 | 43862163 | 4667 | loss | 1688 | DYNC2LI1 | Exon+ve, ≥2 cases | Yes |
| 2 | 37 | 43857496 | 43862163 | 4667 | loss | 1786 | DYNC2LI1 | Exon+ve, ≥2 cases | Yes |
| 2 | 37 | 43857496 | 43862163 | 4667 | loss | 1790 | DYNC2LI1 | Exon+ve, ≥2 cases | Yes |
| 2 | 38 | 44403707 | 44406514 | 2807 | loss | 1504 | PREPL | Exon+ve, ≥2 cases | Yes |
| 2 | 38 | 44403707 | 44406514 | 2807 | gain | 1826 | PREPL | Exon+ve, ≥2 cases | Yes |
| 2 | 39 | 48603879 | 48627703 | 23824 | gain | 1276 | STON1-GTF2A1L, STON1 | Exon+ve, distinct CNVs, same Gene | Yes |
| 2 | 40 | 48666246 | 48676336 | 10090 | gain | 1386 | STON1-GTF2A1L, STON1 | Exon+ve, distinct CNVs, same Gene | Yes |
| 2 | 41 | 50421622 | 50452128 | 30506 | loss | 1597 | NRXN1 | Exon+ve, distinct CNVs, same Gene | Yes |
| 2 | 42 | 50458654 | 50639069 | 180415 | loss | 1597 | NRXN1 | Exon+ve, distinct CNVs, same Gene | Yes |
| 2 | 43 | 50642430 | 50722328 | 79898 | loss | 1597 | NRXN1 | Exon+ve, distinct CNVs, same Gene | Yes |
| 2 | 44 | 73706727 | 73732302 | 25575 | gain | 1369 | NAT8, ALMS1P | Exon+ve, ≥2 cases | Yes |
| 2 | 44 | 73706727 | 73732302 | 25575 | loss | 1551 | NAT8, ALMS1P | Exon+ve, ≥2 cases | Yes |
| 2 | 44 | 73706727 | 73732302 | 25575 | gain | 1626 | NAT8, ALMS1P | Exon+ve, ≥2 cases | Yes |
| 2 | 44 | 73706727 | 73732302 | 25575 | loss | 1728 | NAT8, ALMS1P | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 2 | 45 | 73732303 | 73764497 | 32194 | gain | 1369 | ALMS1P | Exon+ve, ≥2 cases | Yes |
| 2 | 45 | 73732303 | 73764497 | 32194 | gain | 1533 | ALMS1P | Exon+ve, ≥2 cases | Yes |
| 2 | 45 | 73732303 | 73764497 | 32194 | loss | 1551 | ALMS1P | Exon+ve, ≥2 cases | Yes |
| 2 | 45 | 73732303 | 73764497 | 32194 | gain | 1626 | ALMS1P | Exon+ve, ≥2 cases | Yes |
| 2 | 45 | 73732303 | 73764497 | 32194 | loss | 1728 | ALMS1P | Exon+ve, ≥2 cases | Yes |
| 2 | 45 | 73732303 | 73764497 | 32194 | loss | 1738 | ALMS1P | Exon+ve, ≥2 cases | Yes |
| 2 | 45 | 73732303 | 73764497 | 32194 | gain | 1887 | ALMS1P | Exon+ve, ≥2 cases | Yes |
| 2 | 46 | 73764498 | 73766459 | 1961 | gain | 1533 | ALMS1P | Exon+ve, ≥2 cases | Yes |
| 2 | 46 | 73764498 | 73766459 | 1961 | loss | 1551 | ALMS1P | Exon+ve, ≥2 cases | Yes |
| 2 | 46 | 73764498 | 73766459 | 1961 | loss | 1728 | ALMS1P | Exon+ve, ≥2 cases | Yes |
| 2 | 46 | 73764498 | 73766459 | 1961 | loss | 1738 | ALMS1P | Exon+ve, ≥2 cases | Yes |
| 2 | 46 | 73764498 | 73766459 | 1961 | gain | 1887 | ALMS1P | Exon+ve, ≥2 cases | Yes |
| 2 | 47 | 99109502 | 99129872 | 20370 | gain | 1461 | TSGA10, C2orf15 | Exon+ve, ≥2 cases | Yes |
| 2 | 47 | 99109502 | 99129872 | 20370 | gain | 1466 | TSGA10, C2orf15 | Exon+ve, ≥2 cases | Yes |
| 2 | 48 | 99134855 | 99165006 | 30151 | gain | 1461 | TSGA10, MRPL30, MITD1, LIPT1 | Exon+ve, ≥2 cases | Yes |
| 2 | 48 | 99134855 | 99165006 | 30151 | gain | 1466 | TSGA10, MRPL30, MITD1, LIPT1 | Exon+ve, ≥2 cases | Yes |
| 2 | 49 | 106174179 | 106177686 | 3507 | loss | 1505 | UXS1 | Exon+ve, ≥2 cases | Yes |
| 2 | 49 | 106174179 | 106177686 | 3507 | loss | 1611 | UXS1 | Exon+ve, ≥2 cases | Yes |
| 2 | 49 | 106174179 | 106177686 | 3507 | loss | 1697 | UXS1 | Exon+ve, ≥2 cases | Yes |
| 2 | 50 | 106784966 | 106787143 | 2177 | loss | 1592 | ST6GAL2 | Exon+ve, ≥2 cases | Yes |
| 2 | 50 | 106784966 | 106787143 | 2177 | loss | 1720 | ST6GAL2 | Exon+ve, ≥2 cases | Yes |
| 2 | 51 | 125082384 | 125084599 | 2215 | gain | 1532 | CNTNAP5 | Exon+ve, ≥2 cases | Yes |
| 2 | 51 | 125082384 | 125084599 | 2215 | gain | 1803 | CNTNAP5 | Exon+ve, ≥2 cases | Yes |
| 2 | 52 | 135704927 | 135712021 | 7094 | gain | 1451 | ZRANB3 | Exon+ve, ≥2 cases | Yes |
| 2 | 52 | 135704927 | 135712021 | 7094 | loss | 1512 | ZRANB3 | Exon+ve, ≥2 cases | Yes |
| 2 | 52 | 135704927 | 135712021 | 7094 | loss | 1574 | ZRANB3 | Exon+ve, ≥2 cases | Yes |
| 2 | 52 | 135704927 | 135712021 | 7094 | loss | 1757 | ZRANB3 | Exon+ve, ≥2 cases | Yes |
| 2 | 52 | 135704927 | 135712021 | 7094 | gain | 1970 | ZRANB3 | Exon+ve, ≥2 cases | Yes |
| 2 | 53 | 143888582 | 143915868 | 27286 | loss | 1677 | ARHGAP15 | Exon+ve, ≥2 cases | Yes |
| 2 | 53 | 143888582 | 143915868 | 27286 | gain | 1750 | ARHGAP15 | Exon+ve, ≥2 cases | Yes |
| 2 | 54 | 179837050 | 179838443 | 1393 | loss | 1425 | SESTD1 | Exon+ve, ≥2 cases | Yes |
| 2 | 54 | 179837050 | 179838443 | 1393 | loss | 1727 | SESTD1 | Exon+ve, ≥2 cases | Yes |
| 2 | 55 | 201713188 | 201714627 | 1439 | gain | 1344 | CFLAR | Exon+ve, ≥2 cases | Yes |
| 2 | 55 | 201713188 | 201714627 | 1439 | gain | 1824 | CFLAR | Exon+ve, ≥2 cases | Yes |
| 2 | 55 | 201713188 | 201714627 | 1439 | gain | 1841 | CFLAR | Exon+ve, ≥2 cases | Yes |
| 2 | 55 | 201713188 | 201714627 | 1439 | gain | 1927 | CFLAR | Exon+ve, ≥2 cases | Yes |
| 2 | 56 | 201773817 | 201783547 | 9730 | loss | 1534 | CASP10 | Exon+ve, ≥2 cases | Yes |
| 2 | 56 | 201773817 | 201783547 | 9730 | gain | 1943 | CASP10 | Exon+ve, ≥2 cases | Yes |
| 2 | 56 | 206586117 | 206590636 | 4519 | gain | 1220 | INO80D | Exon+ve, ≥2 cases | Yes |
| 2 | 56 | 206586117 | 206590636 | 4519 | gain | 1803 | INO80D | Exon+ve, ≥2 cases | Yes |
| 2 | 56 | 206586117 | 206590636 | 4519 | gain | 1921 | INO80D | Exon+ve, ≥2 cases | Yes |
| 2 | 56 | 206586117 | 206590636 | 4519 | gain | 1988 | INO80D | Exon+ve, ≥2 cases | Yes |
| 2 | 56 | 206586117 | 206590636 | 4519 | gain | 2028 | INO80D | Exon+ve, ≥2 cases | Yes |
| 2 | 57 | 206590637 | 206592116 | 1479 | gain | 1803 | INO80D | Exon+ve, ≥2 cases | Yes |
| 2 | 57 | 206590637 | 206592116 | 1479 | gain | 1921 | INO80D | Exon+ve, ≥2 cases | Yes |
| 2 | 57 | 206590637 | 206592116 | 1479 | gain | 1988 | INO80D | Exon+ve, ≥2 cases | Yes |
| 2 | 57 | 206590637 | 206592116 | 1479 | gain | 2028 | INO80D | Exon+ve, ≥2 cases | Yes |
| 2 | 58 | 213900382 | 213922938 | 22556 | loss | 1832 | SPAG16 | Exon+ve, distinct CNVs, same Gene | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 2 | 59 | 213922938 | 213932901 | 9963 | loss | 1870 | SPAG16 | Exon+ve, distinct CNVs, same Gene | Yes |
| 2 | 60 | 213933570 | 213938010 | 4440 | loss | 1870 | SPAG16 | Exon+ve, distinct CNVs, same Gene | Yes |
| 2 | 61 | 214585717 | 214586936 | 1219 | loss | 1512 | SPAG16 | Exon+ve, ≥2 cases | Yes |
| 2 | 61 | 214585717 | 214586936 | 1219 | loss | 1636 | SPAG16 | Exon+ve, ≥2 cases | Yes |
| 2 | 62 | 214586937 | 214599105 | 12168 | loss | 1636 | SPAG16 | Exon+ve, distinct CNVs, same Gene | Yes |
| 2 | 63 | 218449164 | 218852974 | 3810 | gain | 1284 | PNKD, TMBIM1 | Exon+ve, ≥2 cases | Yes |
| 2 | 63 | 218449164 | 218852974 | 3810 | gain | 1660 | PNKD, TMBIM1 | Exon+ve, ≥2 cases | Yes |
| 2 | 63 | 218449164 | 218852974 | 3810 | gain | 1728 | PNKD, TMBIM1 | Exon+ve, ≥2 cases | Yes |
| 2 | 63 | 218449164 | 218852974 | 3810 | gain | 2024 | PNKD, TMBIM1 | Exon+ve, ≥2 cases | Yes |
| 2 | 64 | 218967950 | 218971707 | 3757 | loss | 1721 | SLC11A1 | Exon+ve, ≥2 cases | Yes |
| 2 | 64 | 218967950 | 218971707 | 3757 | loss | 1993 | SLC11A1 | Exon+ve, ≥2 cases | Yes |
| 2 | 65 | 218972429 | 218975318 | 2889 | loss | 1721 | CTDSP1 | Exon+ve, ≥2 cases | Yes |
| 2 | 65 | 218972429 | 218975318 | 2889 | loss | 1718 | CTDSP1 | Exon+ve, ≥2 cases | Yes |
| 2 | 65 | 218972429 | 218975318 | 2889 | loss | 1913 | CTDSP1 | Exon+ve, ≥2 cases | Yes |
| 2 | 65 | 218972429 | 218975318 | 2889 | loss | 1993 | CTDSP1 | Exon+ve, ≥2 cases | Yes |
| 2 | 66 | 218975319 | 218978243 | 2924 | loss | 1718 | MIR26B, CTDSP1 | Exon+ve, ≥2 cases | Yes |
| 2 | 66 | 218975319 | 218978243 | 2924 | loss | 1721 | MIR26B, CTDSP1 | Exon+ve, ≥2 cases | Yes |
| 2 | 66 | 218975319 | 218978243 | 2924 | loss | 1993 | MIR26B, CTDSP1 | Exon+ve, ≥2 cases | Yes |
| 2 | 67 | 218978244 | 218978839 | 595 | loss | 1721 | CTDSP1 | Exon+ve, ≥2 cases | Yes |
| 2 | 67 | 218978244 | 218978839 | 595 | loss | 1993 | CTDSP1 | Exon+ve, distinct CNVs, same Gene | Yes |
| 3 | 68 | 404591 | 406838 | 2247 | gain | 1598 | CHL1 | Exon+ve, ≥2 cases | Yes |
| 3 | 68 | 404591 | 406838 | 2247 | gain | 1657 | CHL1 | Exon+ve, ≥2 cases | Yes |
| 3 | 69 | 2548711 | 2645342 | 96631 | gain | 1851 | CNTN4 | Special | Yes |
| 3 | 70 | 9720244 | 9722646 | 2402 | loss | 1264 | CPNE9 | Exon+ve, ≥2 cases | Yes |
| 3 | 70 | 9720244 | 9722646 | 2402 | loss | 1587 | CPNE9 | Exon+ve, ≥2 cases | Yes |
| 3 | 70 | 9720244 | 9722646 | 2402 | loss | 1618 | CPNE9 | Exon+ve, ≥2 cases | Yes |
| 3 | 71 | 10210951 | 10217019 | 6068 | loss | 1247 | IRAK2 | Exon+ve, distinct CNVs, same Gene | Yes |
| 3 | 72 | 10249256 | 10254819 | 5563 | loss | 1920 | IRAK2 | Exon+ve, distinct CNVs, same Gene | Yes |
| 3 | 73 | 33868917 | 33871822 | 2905 | loss | 1259 | PDCD6IP | Exon+ve, ≥2 cases | Yes |
| 3 | 73 | 33868917 | 33871822 | 2905 | loss | 1274 | PDCD6IP | Exon+ve, ≥2 cases | Yes |
| 3 | 73 | 33868917 | 33871822 | 2905 | loss | 1724 | PDCD6IP | Exon+ve, ≥2 cases | Yes |
| 3 | 74 | 38415026 | 38417567 | 2541 | loss | 1725 | XYLB | Exon+ve, ≥2 cases | Yes |
| 3 | 74 | 38415026 | 38417567 | 2541 | loss | 1802 | XYLB | Exon+ve, ≥2 cases | Yes |
| 3 | 75 | 46687043 | 46690457 | 3414 | loss | 1318 | ALS2CL | Exon+ve, ≥2 cases | Yes |
| 3 | 75 | 46687043 | 46690457 | 3414 | loss | 1834 | ALS2CL | Exon+ve, ≥2 cases | Yes |
| 3 | 76 | 48603483 | 48611409 | 7926 | loss | 1428 | COL7A1, UQCRC1 | Exon+ve, ≥2 cases | Yes |
| 3 | 76 | 48603483 | 48611409 | 7926 | loss | 1969 | COL7A1, UQCRC1 | Exon+ve, ≥2 cases | Yes |
| 3 | 76 | 48603483 | 48611409 | 7926 | loss | 2035 | COL7A1, UQCRC1 | Exon+ve, ≥2 cases | Yes |
| 3 | 77 | 48611410 | 48667744 | 56334 | loss | 1969 | TMEM89, CELSR3, SLC26A6, UQCRC1 | Exon+ve, ≥2 cases | Yes |
| 3 | 77 | 48611410 | 48667744 | 56334 | loss | 2035 | TMEM89, CELSR3, SLC26A6, UQCRC1 | Exon+ve, ≥2 cases | Yes |
| 3 | 78 | 54504338 | 54514944 | 10606 | gain | 1293 | CACNA2D3 | Exon+ve, ≥2 cases | Yes |
| 3 | 78 | 54504338 | 54514944 | 10606 | gain | 1921 | CACNA2D3 | Exon+ve, ≥2 cases | Yes |
| 3 | 79 | 58161589 | 58171419 | 9830 | gain | 1267 | DNASE1L3 | Exon+ve, ≥2 cases | Yes |
| 3 | 79 | 58161589 | 58171419 | 9830 | gain | 1268 | DNASE1L3 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 3 | 79 | 58161589 | 58171419 | 9830 | gain | 1354 | DNASE1L3 | Exon+ve, ≥2 cases | Yes |
| 3 | 80 | 59891946 | 60045382 | 153436 | gain | 1936 | FHIT | Exon+ve, ≥2 cases | Yes |
| 3 | 80 | 59891946 | 60045382 | 153436 | loss | 1991 | FHIT | Exon+ve, ≥2 cases | Yes |
| 3 | 81 | 64479002 | 64486008 | 7006 | loss | 1428 | ADAMTS9 | Exon+ve, ≥2 cases | Yes |
| 3 | 81 | 64479002 | 64486008 | 7006 | loss | 1434 | ADAMTS9 | Exon+ve, ≥2 cases | Yes |
| 3 | 81 | 64479002 | 64486008 | 7006 | loss | 1572 | ADAMTS9 | Exon+ve, ≥2 cases | Yes |
| 3 | 81 | 64479002 | 64486008 | 7006 | loss | 1592 | ADAMTS9 | Exon+ve, ≥2 cases | Yes |
| 3 | 81 | 64479002 | 64486008 | 7006 | loss | 1763 | ADAMTS9 | Exon+ve, ≥2 cases | Yes |
| 3 | 82 | 96161892 | 96165551 | 3659 | loss | 1619 | LOC255025 | Exon+ve, ≥2 cases | Yes |
| 3 | 82 | 96161892 | 96165551 | 3659 | loss | 1624 | LOC255025 | Exon+ve, ≥2 cases | Yes |
| 3 | 83 | 155353325 | 155355022 | 1697 | gain | 1371 | ARHGEF26 | Exon+ve, distinct CNVs, same Gene | Yes |
| 3 | 84 | 155389583 | 155391992 | 2409 | gain | 1446 | ARHGEF26 | Exon+ve, distinct CNVs, same Gene | Yes |
| 3 | 85 | 197276556 | 197285789 | 9233 | gain | 1227 | TFRC | Exon+ve, ≥2 cases | Yes |
| 3 | 85 | 197276556 | 197285789 | 9233 | gain | 1565 | TFRC | Exon+ve, ≥2 cases | Yes |
| 3 | 86 | 197289125 | 197410852 | 121727 | gain | 1227 | LOC401109, TFRC, ZDHHC19 | Exon+ve, ≥2 cases | Yes |
| 3 | 86 | 197289125 | 197410852 | 121727 | gain | 1565 | LOC401109, TFRC, ZDHHC19 | Exon+ve, ≥2 cases | Yes |
| 3 | 87 | 197516474 | 197531031 | 14557 | gain | 1227 | TCTEX1D2, TM4SF19-TCTEX1D2 | Exon+ve, ≥2 cases | Yes |
| 3 | 87 | 197516474 | 197531031 | 14557 | gain | 1565 | TCTEX1D2, TM4SF19-TCTEX1D2 | Exon+ve, ≥2 cases | Yes |
| 3 | 88 | 197537870 | 197560934 | 23064 | gain | 1565 | TM4SF19, TM4SF19-TCTEX1D2 | Exon+ve, ≥2 cases | Yes |
| 3 | 88 | 197537870 | 197560934 | 23064 | gain | 1775 | TM4SF19, TM4SF19-TCTEX1D2 | Exon+ve, ≥2 cases | Yes |
| 3 | 89 | 197712985 | 197736785 | 23800 | loss | 1546 | RNF168, C3orf43 | Exon+ve, ≥2 cases | Yes |
| 3 | 89 | 197712985 | 197736785 | 23800 | gain | 1565 | RNF168, C3orf43 | Exon+ve, ≥2 cases | Yes |
| 3 | 90 | 197848634 | 197857567 | 8933 | loss | 1285 | LRRC33 | Exon+ve, ≥2 cases | Yes |
| 3 | 90 | 197848634 | 197857567 | 8933 | gain | 1565 | LRRC33 | Exon+ve, ≥2 cases | Yes |
| 3 | 90 | 197848634 | 197857567 | 8933 | loss | 1909 | LRRC33 | Exon+ve, ≥2 cases | Yes |
| 3 | 90 | 197848634 | 197857567 | 8933 | loss | 2030 | LRRC33 | Exon+ve, ≥2 cases | Yes |
| 4 | 91 | 20161068 | 20161847 | 779 | loss | 1426 | SLIT2 | Exon+ve, ≥2 cases | Yes |
| 4 | 91 | 20161068 | 20161847 | 779 | loss | 1528 | SLIT2 | Exon+ve, ≥2 cases | Yes |
| 4 | 91 | 20161068 | 20161847 | 779 | loss | 1665 | SLIT2 | Exon+ve, ≥2 cases | Yes |
| 4 | 91 | 20161068 | 20161847 | 779 | loss | 1667 | SLIT2 | Exon+ve, ≥2 cases | Yes |
| 4 | 91 | 20161068 | 20161847 | 779 | loss | 1671 | SLIT2 | Exon+ve, ≥2 cases | Yes |
| 4 | 92 | 39829776 | 39834522 | 4746 | loss | 1883 | N4BP2 | Exon+ve, ≥2 cases | Yes |
| 4 | 92 | 39829776 | 39834522 | 4746 | loss | 1947 | N4BP2 | Exon+ve, ≥2 cases | Yes |
| 4 | 93 | 44319603 | 44327596 | 7993 | loss | 1487 | YIPF7 | Exon+ve, ≥2 cases | Yes |
| 4 | 93 | 44319603 | 44327596 | 7993 | loss | 1659 | YIPF7 | Exon+ve, ≥2 cases | Yes |
| 4 | 94 | 47314693 | 47335844 | 21151 | loss | 1308 | CORIN | Exon+ve, distinct CNVs, same Gene | Yes |
| 4 | 95 | 47358255 | 47359575 | 1320 | gain | 1252 | CORIN | Exon+ve, ≥2 cases | Yes |
| 4 | 95 | 47358255 | 47359575 | 1320 | gain | 1658 | CORIN | Exon+ve, ≥2 cases | Yes |
| 4 | 96 | 47359576 | 47361851 | 2275 | gain | 1252 | CORIN | Exon+ve, distinct CNVs, same Gene | Yes |
| 4 | 97 | 56070868 | 56072258 | 1390 | loss | 1529 | CLOCK | Exon+ve, ≥2 cases | Yes |
| 4 | 97 | 56070868 | 56072258 | 1390 | loss | 1738 | CLOCK | Exon+ve, ≥2 cases | Yes |
| 4 | 98 | 68168394 | 68172597 | 4203 | loss | 1221 | UBA6 | Exon+ve, ≥2 cases | Yes |
| 4 | 98 | 68168394 | 68172597 | 4203 | loss | 1222 | UBA6 | Exon+ve, ≥2 cases | Yes |
| 4 | 99 | 70523201 | 70551081 | 27880 | loss | 1285 | UGT2A2, UGT2A1 | Exon+ve, ≥2 cases | Yes |
| 4 | 99 | 70523201 | 70551081 | 27880 | loss | 1433 | UGT2A2, UGT2A1 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 4 | 100 | 74035932 | 74268619 | 232687 | gain | 1347 | COX18, ANKRD17 | Exon+ve, ≥2 cases | Yes |
| 4 | 100 | 74035932 | 74268619 | 232687 | gain | 1945 | COX18, ANKRD17 | Exon+ve, ≥2 cases | Yes |
| 4 | 101 | 74504402 | 74511880 | 7478 | loss | 1373 | ALB | Exon+ve, ≥2 cases | Yes |
| 4 | 101 | 74504402 | 74511880 | 7478 | loss | 1464 | ALB | Exon+ve, ≥2 cases | Yes |
| 4 | 101 | 74504402 | 74511880 | 7478 | loss | 1798 | ALB | Exon+ve, ≥2 cases | Yes |
| 4 | 101 | 74504402 | 74511880 | 7478 | loss | 1852 | ALB | Exon+ve, ≥2 cases | Yes |
| 4 | 101 | 74504402 | 74511880 | 7478 | loss | 1959 | ALB | Exon+ve, ≥2 cases | Yes |
| 4 | 102 | 99104657 | 99112516 | 7859 | gain | 1489 | C4orf37 | Exon+ve, distinct CNVs, same Gene | Yes |
| 4 | 103 | 99278436 | 99382350 | 103914 | loss | 1534 | C4orf37 | Exon+ve, distinct CNVs, same Gene | Yes |
| 4 | 104 | 100955189 | 100969192 | 14003 | gain | 1462 | DAPP1 | Exon+ve, ≥2 cases | Yes |
| 4 | 104 | 100955189 | 100969192 | 14003 | gain | 1913 | DAPP1 | Exon+ve, ≥2 cases | Yes |
| 4 | 105 | 100980535 | 101000511 | 19976 | gain | 1462 | DAPP1 | Exon+ve, ≥2 cases | Yes |
| 4 | 105 | 100980535 | 101000511 | 19976 | gain | 1913 | DAPP1 | Exon+ve, ≥2 cases | Yes |
| 4 | 106 | 101572938 | 101587882 | 14944 | gain | 1752 | EMCN | Exon+ve, ≥2 cases | Yes |
| 4 | 106 | 101572938 | 101587882 | 14944 | gain | 1867 | EMCN | Exon+ve, ≥2 cases | Yes |
| 4 | 107 | 107311633 | 107316223 | 4590 | loss | 1280 | TBCK | Exon+ve, ≥2 cases | Yes |
| 4 | 107 | 107311633 | 107316223 | 4590 | loss | 1933 | TBCK | Exon+ve, ≥2 cases | Yes |
| 4 | 108 | 149047165 | 149047423 | 258 | loss | 1498 | ARHGAP10 | Exon+ve, ≥2 cases | Yes |
| 4 | 108 | 149047165 | 149047423 | 258 | loss | 1916 | ARHGAP10 | Exon+ve, ≥2 cases | Yes |
| 4 | 109 | 186681554 | 186689469 | 7915 | gain | 1281 | PDLIM3 | Exon+ve, ≥2 cases | Yes |
| 4 | 109 | 186681554 | 186689469 | 7915 | gain | 1458 | PDLIM3 | Exon+ve, ≥2 cases | Yes |
| 4 | 110 | 189296361 | 189297555 | 1194 | gain | 1691 | TRIML1 | Exon+ve, ≥2 cases | Yes |
| 4 | 110 | 189296361 | 189297555 | 1194 | gain | 1704 | TRIML1 | Exon+ve, ≥2 cases | Yes |
| 4 | 111 | 191041482 | 191133608 | 92126 | gain | 1230 | FRG1 | Exon+ve, ≥2 cases | Yes |
| 4 | 111 | 191041482 | 191133608 | 92126 | gain | 1292 | FRG1 | Exon+ve, ≥2 cases | Yes |
| 4 | 111 | 191041482 | 191133608 | 92126 | gain | 1411 | FRG1 | Exon+ve, ≥2 cases | Yes |
| 5 | 112 | 10688337 | 10691335 | 2998 | loss | 1438 | ANKRD33B | Exon+ve, ≥2 cases | Yes |
| 5 | 112 | 10688337 | 10691335 | 2998 | loss | 1619 | ANKRD33B | Exon+ve, ≥2 cases | Yes |
| 5 | 112 | 10688337 | 10691335 | 2998 | loss | 1629 | ANKRD33B | Exon+ve, ≥2 cases | Yes |
| 5 | 112 | 10688337 | 10691335 | 2998 | loss | 1630 | ANKRD33B | Exon+ve, ≥2 cases | Yes |
| 5 | 112 | 10688337 | 10691335 | 2998 | loss | 1666 | ANKRD33B | Exon+ve, ≥2 cases | Yes |
| 5 | 112 | 10688337 | 10691335 | 2998 | loss | 1850 | ANKRD33B | Exon+ve, ≥2 cases | Yes |
| 5 | 112 | 10688337 | 10691335 | 2998 | loss | 1998 | ANKRD33B | Exon+ve, ≥2 cases | Yes |
| 5 | 112 | 10688337 | 10691335 | 2998 | loss | 2026 | ANKRD33B | Exon+ve, ≥2 cases | Yes |
| 5 | 113 | 14184901 | 14235806 | 50905 | gain | 1282 | TRIO | Exon+ve, distinct CNVs, same Gene | Yes |
| 5 | 114 | 14333156 | 14334923 | 1767 | gain | 1417 | TRIO | Exon+ve, distinct CNVs, same Gene | Yes |
| 5 | 115 | 37398626 | 37405778 | 7152 | loss | 1426 | NUP155 | Exon+ve, ≥2 cases | Yes |
| 5 | 115 | 37398626 | 37405778 | 7152 | gain | 1765 | NUP155 | Exon+ve, ≥2 cases | Yes |
| 5 | 116 | 89477991 | 90081196 | 603205 | gain | 1786 | LYSMD3, POLR3G, CETN3, MBLAC2, GPR98 | Exon+ve, ≥2 cases | Yes |
| 5 | 116 | 89477991 | 90081196 | 603205 | gain | 1886 | LYSMD3, POLR3G, CETN3, MBLAC2, GPR98 | Exon+ve, ≥2 cases | Yes |
| 5 | 117 | 90081197 | 90084436 | 3239 | gain | 1489 | GPR98 | Exon+ve, ≥2 cases | Yes |
| 5 | 117 | 90081197 | 90084436 | 3239 | gain | 1786 | GPR98 | Exon+ve, ≥2 cases | Yes |
| 5 | 117 | 90081197 | 90084436 | 3239 | gain | 1886 | GPR98 | Exon+ve, ≥2 cases | Yes |
| 5 | 118 | 90084437 | 90142704 | 58267 | gain | 1786 | GPR98 | Exon+ve, ≥2 cases | Yes |
| 5 | 118 | 90084437 | 90142704 | 58267 | gain | 1886 | GPR98 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 5 | 119 | 95183456 | 95189721 | 6265 | gain | 1281 | GLRX | Exon+ve, ≥2 cases | Yes |
| 5 | 119 | 95183456 | 95189721 | 6265 | gain | 1824 | GLRX | Exon+ve, ≥2 cases | Yes |
| 5 | 120 | 122534134 | 122535395 | 1261 | loss | 1224 | PRDM6 | Exon+ve, ≥2 cases | Yes |
| 5 | 120 | 122534134 | 122535395 | 1261 | loss | 1548 | PRDM6 | Exon+ve, ≥2 cases | Yes |
| 5 | 120 | 122534134 | 122535395 | 1261 | loss | 1552 | PRDM6 | Exon+ve, ≥2 cases | Yes |
| 5 | 120 | 122534134 | 122535395 | 1261 | loss | 1681 | PRDM6 | Exon+ve, ≥2 cases | Yes |
| 5 | 120 | 122534134 | 122535395 | 1261 | loss | 1740 | PRDM6 | Exon+ve, ≥2 cases | Yes |
| 5 | 120 | 122534134 | 122535395 | 1261 | loss | 1763 | PRDM6 | Exon+ve, ≥2 cases | Yes |
| 5 | 120 | 122534134 | 122535395 | 1261 | loss | 1786 | PRDM6 | Exon+ve, ≥2 cases | Yes |
| 5 | 120 | 122534134 | 122535395 | 1261 | loss | 1807 | PRDM6 | Exon+ve, ≥2 cases | Yes |
| 5 | 120 | 122534134 | 122535395 | 1261 | loss | 1880 | PRDM6 | Exon+ve, ≥2 cases | Yes |
| 5 | 120 | 122534134 | 122535395 | 1261 | loss | 1881 | PRDM6 | Exon+ve, ≥2 cases | Yes |
| 5 | 120 | 122534134 | 122535395 | 1261 | loss | 1915 | PRDM6 | Exon+ve, ≥2 cases | Yes |
| 5 | 121 | 128326107 | 128331280 | 5173 | loss | 1248 | SLC27A6 | Exon+ve, ≥2 cases | Yes |
| 5 | 121 | 128326107 | 128331280 | 5173 | loss | 1699 | SLC27A6 | Exon+ve, ≥2 cases | Yes |
| 5 | 122 | 150506984 | 150518075 | 11091 | loss | 1433 | ANXA6 | Exon+ve, ≥2 cases | Yes |
| 5 | 122 | 150506984 | 150518075 | 11091 | loss | 1942 | ANXA6 | Exon+ve, ≥2 cases | Yes |
| 5 | 123 | 180189516 | 180365977 | 176461 | Loss | 1532 | BTNL3 | Ctrl pos High OR | Yes |
| 5 | 123 | 180189516 | 180365977 | 176461 | Loss | 1612 | BTNL3 | Ctrl pos High OR | Yes |
| 5 | 123 | 180189516 | 180365977 | 176461 | Loss | 1686 | BTNL3 | Ctrl pos High OR | Yes |
| 5 | 123 | 180189516 | 180192213 | 2697 | loss | 1229 | LOC729678 | Exon+ve, ≥2 cases | Yes |
| 5 | 123 | 180189516 | 180192213 | 2697 | loss | 1532 | LOC729678 | Exon+ve, ≥2 cases | Yes |
| 5 | 123 | 180189516 | 180192213 | 2697 | loss | 1548 | LOC729678 | Exon+ve, ≥2 cases | Yes |
| 5 | 123 | 180189516 | 180192213 | 2697 | loss | 1612 | LOC729678 | Exon+ve, ≥2 cases | Yes |
| 5 | 123 | 180189516 | 180192213 | 2697 | loss | 1686 | LOC729678 | Exon+ve, ≥2 cases | Yes |
| 5 | 123 | 180189516 | 180192213 | 2697 | loss | 1861 | LOC729678 | Exon+ve, ≥2 cases | Yes |
| 5 | 123 | 180189516 | 180365977 | 173763 | Loss | 1606 | BTNL3 | Ctrl pos High OR | Yes |
| 5 | 124 | 180192214 | 180194322 | 2108 | loss | 1229 | LOC729678 | Exon+ve, ≥2 cases | Yes |
| 5 | 124 | 180192214 | 180194322 | 2108 | gain | 1316 | LOC729678 | Exon+ve, ≥2 cases | Yes |
| 5 | 124 | 180192214 | 180194322 | 2108 | loss | 1532 | LOC729678 | Exon+ve, ≥2 cases | Yes |
| 5 | 124 | 180192214 | 180194322 | 2108 | loss | 1548 | LOC729678 | Exon+ve, ≥2 cases | Yes |
| 5 | 124 | 180192214 | 180194322 | 2108 | loss | 1580 | LOC729678 | Exon+ve, ≥2 cases | Yes |
| 5 | 124 | 180192214 | 180194322 | 2108 | loss | 1606 | LOC729678 | Exon+ve, ≥2 cases | Yes |
| 5 | 124 | 180192214 | 180194322 | 2108 | loss | 1612 | LOC729678 | Exon+ve, ≥2 cases | Yes |
| 5 | 124 | 180192214 | 180194322 | 2108 | loss | 1641 | LOC729678 | Exon+ve, ≥2 cases | Yes |
| 5 | 124 | 180192214 | 180194322 | 2108 | loss | 1686 | LOC729678 | Exon+ve, ≥2 cases | Yes |
| 5 | 124 | 180192214 | 180194322 | 2108 | loss | 1861 | LOC729678 | Exon+ve, ≥2 cases | Yes |
| 5 | 125 | 180194323 | 180378586 | 184263 | Loss | 1429 | BTNL3 | Ctrl pos High OR | Yes |
| 5 | 125 | 180194323 | 180365977 | 171654 | Loss | 1546 | BTNL3 | Ctrl pos High OR | Yes |
| 5 | 125 | 180194323 | 180378586 | 184263 | Loss | 1634 | BTNL3 | Ctrl pos High OR | Yes |
| 5 | 125 | 180194323 | 180365977 | 171654 | Loss | 1696 | BTNL3 | Ctrl pos High OR | Yes |
| 5 | 125 | 180194323 | 180365977 | 171654 | Loss | 1792 | BTNL3 | Ctrl pos High OR | Yes |
| 5 | 125 | 180194323 | 180378586 | 184263 | Loss | 1851 | BTNL3 | Ctrl pos High OR | Yes |
| 5 | 125 | 180194323 | 180365977 | 171654 | Loss | 1902 | BTNL3 | Ctrl pos High OR | Yes |
| 5 | 125 | 180194323 | 180365977 | 171654 | Loss | 1927 | BTNL3 | Ctrl pos High OR | Yes |
| 5 | 126 | 180344964 | 180365977 | 21013 | Loss | 1261 | BTNL3 | Ctrl pos High OR | Yes |
| 5 | 126 | 180344964 | 180365977 | 21013 | Loss | 1265 | BTNL3 | Ctrl pos High OR | Yes |
| 5 | 126 | 180344964 | 180378586 | 33622 | Loss | 1268 | BTNL3 | Ctrl pos High OR | Yes |
| 5 | 126 | 180344964 | 180379663 | 34699 | Loss | 1277 | BTNL3 | Ctrl pos High OR | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 5 | 126 | 180344964 | 180378586 | 33622 | Loss | 1354 | BTNL3 | Ctrl pos High OR | Yes |
| 5 | 126 | 180344964 | 180365977 | 21013 | Loss | 1438 | BTNL3 | Ctrl pos High OR | Yes |
| 5 | 126 | 180344964 | 180378586 | 33622 | Loss | 1463 | BTNL3 | Ctrl pos High OR | Yes |
| 5 | 126 | 180344964 | 180365977 | 21013 | Loss | 1467 | BTNL3 | Ctrl pos High OR | Yes |
| 5 | 126 | 180344964 | 180365977 | 21013 | Loss | 1568 | BTNL3 | Ctrl pos High OR | Yes |
| 5 | 126 | 180344964 | 180365977 | 21013 | Loss | 1570 | BTNL3 | Ctrl pos High OR | Yes |
| 5 | 126 | 180344964 | 180365977 | 21013 | Loss | 1662 | BTNL3 | Ctrl pos High OR | Yes |
| 5 | 126 | 180344964 | 180365977 | 21013 | Loss | 1671 | BTNL3 | Ctrl pos High OR | Yes |
| 5 | 126 | 180344964 | 180365977 | 21013 | Loss | 1726 | BTNL3 | Ctrl pos High OR | Yes |
| 5 | 126 | 180344964 | 180365977 | 21013 | Loss | 1769 | BTNL3 | Ctrl pos High OR | Yes |
| 5 | 126 | 180344964 | 180365977 | 21013 | Loss | 1799 | BTNL3 | Ctrl pos High OR | Yes |
| 5 | 126 | 180344964 | 180365977 | 21013 | Loss | 1849 | BTNL3 | Ctrl pos High OR | Yes |
| 5 | 126 | 180344964 | 180378586 | 33622 | Loss | 1540 | BTNL3 | Ctrl pos High OR | Yes |
| 5 | 127 | 180346557 | 180365977 | 19420 | Loss | 1754 | BTNL3 | Ctrl pos High OR | Yes |
| 5 | 127 | 180346557 | 180365977 | 19420 | Loss | 1755 | BTNL3 | Ctrl pos High OR | Yes |
| 5 | 127 | 180346557 | 180378586 | 32029 | Loss | 1942 | BTNL3 | Ctrl pos High OR | Yes |
| 6 | 128 | 26539830 | 26571434 | 31604 | gain | 1842 | BTN2A1, BTN3A3 | Exon+ve, ≥2 cases | Yes |
| 6 | 128 | 26539830 | 26571434 | 31604 | loss | 1968 | BTN2A1, BTN3A3 | Exon+ve, ≥2 cases | Yes |
| 6 | 129 | 29653815 | 29658113 | 4298 | loss | 1275 | SNORD32B | Exon+ve, ≥2 cases | Yes |
| 6 | 129 | 29653815 | 29658113 | 4298 | loss | 1440 | SNORD32B | Exon+ve, ≥2 cases | Yes |
| 6 | 129 | 29653815 | 29658113 | 4298 | loss | 1750 | SNORD32B | Exon+ve, ≥2 cases | Yes |
| 6 | 129 | 29653815 | 29658113 | 4298 | loss | 1862 | SNORD32B | Exon+ve, ≥2 cases | Yes |
| 6 | 130 | 30046182 | 30052053 | 5871 | loss | 1244 | HCG9 | Exon+ve, ≥2 cases | Yes |
| 6 | 130 | 30046182 | 30052053 | 5871 | loss | 1488 | HCG9 | Exon+ve, ≥2 cases | Yes |
| 6 | 131 | 33491109 | 33492393 | 1284 | loss | 1297 | CUTA, PHF1 | Exon+ve, ≥2 cases | Yes |
| 6 | 131 | 33491109 | 33492393 | 1284 | loss | 1718 | CUTA, PHF1 | Exon+ve, ≥2 cases | Yes |
| 6 | 131 | 33491109 | 33492393 | 1284 | loss | 1841 | CUTA, PHF1 | Exon+ve, ≥2 cases | Yes |
| 6 | 131 | 33491109 | 33492393 | 1284 | loss | 1905 | CUTA, PHF1 | Exon+ve, ≥2 cases | Yes |
| 6 | 131 | 33491109 | 33492393 | 1284 | loss | 2031 | CUTA, PHF1 | Exon+ve, ≥2 cases | Yes |
| 6 | 131 | 33491109 | 33492393 | 1284 | loss | 2032 | CUTA, PHF1 | Exon+ve, ≥2 cases | Yes |
| 6 | 132 | 33492394 | 33495073 | 2679 | loss | 1297 | CUTA | Exon+ve, ≥2 cases | Yes |
| 6 | 132 | 33492394 | 33495073 | 2679 | loss | 1718 | CUTA | Exon+ve, ≥2 cases | Yes |
| 6 | 132 | 33492394 | 33495073 | 2679 | loss | 1841 | CUTA | Exon+ve, ≥2 cases | Yes |
| 6 | 132 | 33492394 | 33495073 | 2679 | loss | 1872 | CUTA | Exon+ve, ≥2 cases | Yes |
| 6 | 132 | 33492394 | 33495073 | 2679 | loss | 1905 | CUTA | Exon+ve, ≥2 cases | Yes |
| 6 | 132 | 33492394 | 33495073 | 2679 | loss | 1967 | CUTA | Exon+ve, ≥2 cases | Yes |
| 6 | 132 | 33492394 | 33495073 | 2679 | loss | 2031 | CUTA | Exon+ve, ≥2 cases | Yes |
| 6 | 132 | 33492394 | 33495073 | 2679 | loss | 2032 | CUTA | Exon+ve, ≥2 cases | Yes |
| 6 | 133 | 33495074 | 33504619 | 9545 | loss | 1297 | SYNGAP1 | Exon+ve, ≥2 cases | Yes |
| 6 | 133 | 33495074 | 33504619 | 9545 | loss | 1718 | SYNGAP1 | Exon+ve, ≥2 cases | Yes |
| 6 | 133 | 33495074 | 33504619 | 9545 | loss | 1824 | SYNGAP1 | Exon+ve, ≥2 cases | Yes |
| 6 | 133 | 33495074 | 33504619 | 9545 | loss | 1840 | SYNGAP1 | Exon+ve, ≥2 cases | Yes |
| 6 | 133 | 33495074 | 33504619 | 9545 | loss | 1841 | SYNGAP1 | Exon+ve, ≥2 cases | Yes |
| 6 | 133 | 33495074 | 33504619 | 9545 | loss | 1872 | SYNGAP1 | Exon+ve, ≥2 cases | Yes |
| 6 | 133 | 33495074 | 33504619 | 9545 | loss | 1905 | SYNGAP1 | Exon+ve, ≥2 cases | Yes |
| 6 | 133 | 33495074 | 33504619 | 9545 | loss | 1967 | SYNGAP1 | Exon+ve, ≥2 cases | Yes |
| 6 | 133 | 33495074 | 33504619 | 9545 | loss | 2031 | SYNGAP1 | Exon+ve, ≥2 cases | Yes |
| 6 | 133 | 33495074 | 33504619 | 9545 | loss | 2032 | SYNGAP1 | Exon+ve, ≥2 cases | Yes |
| 6 | 134 | 35851495 | 35853208 | 1713 | loss | 1680 | C6orf126 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 6 | 134 | 35851495 | 35853208 | 1713 | loss | 1694 | C6orf26 | Exon+ve, ≥2 cases | Yes |
| 6 | 134 | 35851495 | 35853208 | 1713 | loss | 1718 | C6orf26 | Exon+ve, ≥2 cases | Yes |
| 6 | 134 | 35851495 | 35853208 | 1713 | loss | 1852 | C6orf26 | Exon+ve, ≥2 cases | Yes |
| 6 | 134 | 35851495 | 35853208 | 1713 | loss | 1950 | C6orf26 | Exon+ve, ≥2 cases | Yes |
| 6 | 134 | 35851495 | 35853208 | 1713 | loss | 1965 | C6orf26 | Exon+ve, ≥2 cases | Yes |
| 6 | 134 | 35851495 | 35853208 | 1713 | loss | 2006 | C6orf26 | Exon+ve, ≥2 cases | Yes |
| 6 | 134 | 35851495 | 35853208 | 1713 | loss | 2018 | C6orf26 | Exon+ve, ≥2 cases | Yes |
| 6 | 135 | 35853209 | 35855651 | 2442 | loss | 1680 | C6orf26 | Exon+ve, ≥2 cases | Yes |
| 6 | 135 | 35853209 | 35855651 | 2442 | loss | 1694 | C6orf26 | Exon+ve, ≥2 cases | Yes |
| 6 | 135 | 35853209 | 35855651 | 2442 | loss | 1718 | C6orf26 | Exon+ve, ≥2 cases | Yes |
| 6 | 135 | 35853209 | 35855651 | 2442 | loss | 1852 | C6orf26 | Exon+ve, ≥2 cases | Yes |
| 6 | 135 | 35853209 | 35855651 | 2442 | loss | 1940 | C6orf26 | Exon+ve, ≥2 cases | Yes |
| 6 | 135 | 35853209 | 35855651 | 2442 | loss | 1946 | C6orf26 | Exon+ve, ≥2 cases | Yes |
| 6 | 135 | 35853209 | 35855651 | 2442 | loss | 1950 | C6orf26 | Exon+ve, ≥2 cases | Yes |
| 6 | 135 | 35853209 | 35855651 | 2442 | loss | 1958 | C6orf26 | Exon+ve, ≥2 cases | Yes |
| 6 | 135 | 35853209 | 35855651 | 2442 | loss | 1961 | C6orf26 | Exon+ve, ≥2 cases | Yes |
| 6 | 135 | 35853209 | 35855651 | 2442 | loss | 1962 | C6orf26 | Exon+ve, ≥2 cases | Yes |
| 6 | 135 | 35853209 | 35855651 | 2442 | loss | 1965 | C6orf26 | Exon+ve, ≥2 cases | Yes |
| 6 | 135 | 35853209 | 35855651 | 2442 | loss | 2005 | C6orf26 | Exon+ve, ≥2 cases | Yes |
| 6 | 135 | 35853209 | 35855651 | 2442 | loss | 2006 | C6orf26 | Exon+ve, ≥2 cases | Yes |
| 6 | 135 | 35853209 | 35855651 | 2442 | loss | 2018 | C6orf26 | Exon+ve, ≥2 cases | Yes |
| 6 | 136 | 35855652 | 35856921 | 1269 | loss | 1301 | C6orf27 | Exon+ve, ≥2 cases | Yes |
| 6 | 136 | 35855652 | 35856921 | 1269 | loss | 1680 | C6orf27 | Exon+ve, ≥2 cases | Yes |
| 6 | 136 | 35855652 | 35856921 | 1269 | loss | 1694 | C6orf27 | Exon+ve, ≥2 cases | Yes |
| 6 | 136 | 35855652 | 35856921 | 1269 | loss | 1718 | C6orf27 | Exon+ve, ≥2 cases | Yes |
| 6 | 136 | 35855652 | 35856921 | 1269 | loss | 1837 | C6orf27 | Exon+ve, ≥2 cases | Yes |
| 6 | 136 | 35855652 | 35856921 | 1269 | loss | 1839 | C6orf27 | Exon+ve, ≥2 cases | Yes |
| 6 | 136 | 35855652 | 35856921 | 1269 | loss | 1852 | C6orf27 | Exon+ve, ≥2 cases | Yes |
| 6 | 136 | 35855652 | 35856921 | 1269 | loss | 1940 | C6orf27 | Exon+ve, ≥2 cases | Yes |
| 6 | 136 | 35855652 | 35856921 | 1269 | loss | 1946 | C6orf27 | Exon+ve, ≥2 cases | Yes |
| 6 | 136 | 35855652 | 35856921 | 1269 | loss | 1950 | C6orf27 | Exon+ve, ≥2 cases | Yes |
| 6 | 136 | 35855652 | 35856921 | 1269 | loss | 1952 | C6orf27 | Exon+ve, ≥2 cases | Yes |
| 6 | 136 | 35855652 | 35856921 | 1269 | loss | 1958 | C6orf27 | Exon+ve, ≥2 cases | Yes |
| 6 | 136 | 35855652 | 35856921 | 1269 | loss | 1959 | C6orf27 | Exon+ve, ≥2 cases | Yes |
| 6 | 136 | 35855652 | 35856921 | 1269 | loss | 1961 | C6orf27 | Exon+ve, ≥2 cases | Yes |
| 6 | 136 | 35855652 | 35856921 | 1269 | loss | 1962 | C6orf27 | Exon+ve, ≥2 cases | Yes |
| 6 | 136 | 35855652 | 35856921 | 1269 | loss | 1965 | C6orf27 | Exon+ve, ≥2 cases | Yes |
| 6 | 136 | 35855652 | 35856921 | 1269 | loss | 2005 | C6orf27 | Exon+ve, ≥2 cases | Yes |
| 6 | 136 | 35855652 | 35856921 | 1269 | loss | 2006 | C6orf27 | Exon+ve, ≥2 cases | Yes |
| 6 | 136 | 35855652 | 35856921 | 1269 | loss | 2018 | C6orf27 | Exon+ve, ≥2 cases | Yes |
| 6 | 137 | 74521789 | 74527607 | 5818 | gain | 1638 | CD109 | Exon+ve, ≥2 cases | Yes |
| 6 | 137 | 74521789 | 74527607 | 5818 | gain | 1894 | CD109 | Exon+ve, ≥2 cases | Yes |
| 6 | 138 | 105298062 | 105303833 | 5771 | loss | 1426 | HACE1 | Exon+ve, ≥2 cases | Yes |
| 6 | 138 | 105298062 | 105303833 | 5771 | loss | 1458 | HACE1 | Exon+ve, ≥2 cases | Yes |
| 6 | 138 | 105298062 | 105303833 | 5771 | loss | 1490 | HACE1 | Exon+ve, ≥2 cases | Yes |
| 6 | 138 | 105298062 | 105303833 | 5771 | loss | 1492 | HACE1 | Exon+ve, ≥2 cases | Yes |
| 6 | 138 | 105298062 | 105303833 | 5771 | loss | 1500 | HACE1 | Exon+ve, ≥2 cases | Yes |
| 6 | 139 | 134624093 | 134627340 | 3247 | loss | 1224 | SGK1 | Exon+ve, ≥2 cases | Yes |
| 6 | 139 | 134624093 | 134627340 | 3247 | loss | 1576 | SGK1 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 6 | 139 | 134624093 | 134627340 | 3247 | loss | 1667 | SGK1 | Exon+ve, ≥2 cases | Yes |
| 6 | 139 | 134624093 | 134627340 | 3247 | loss | 1708 | SGK1 | Exon+ve, ≥2 cases | Yes |
| 6 | 140 | 139638465 | 139641157 | 2692 | loss | 1387 | TXLNB | Exon+ve, ≥2 cases | Yes |
| 6 | 140 | 139638465 | 139641157 | 2692 | loss | 1396 | TXLNB | Exon+ve, ≥2 cases | Yes |
| 6 | 140 | 139638465 | 139641157 | 2692 | loss | 1401 | TXLNB | Exon+ve, ≥2 cases | Yes |
| 6 | 140 | 139638465 | 139641157 | 2692 | loss | 1403 | TXLNB | Exon+ve, ≥2 cases | Yes |
| 6 | 140 | 139638465 | 139641157 | 2692 | loss | 1696 | TXLNB | Exon+ve, ≥2 cases | Yes |
| 6 | 140 | 139638465 | 139641157 | 2692 | loss | 1895 | TXLNB | Exon+ve, ≥2 cases | Yes |
| 6 | 141 | 143693693 | 143696258 | 2565 | gain | 1281 | AIG1 | Exon+ve, ≥2 cases | Yes |
| 6 | 141 | 143693693 | 143696258 | 2565 | gain | 1372 | AIG1 | Exon+ve, ≥2 cases | Yes |
| 6 | 141 | 143693693 | 143696258 | 2565 | gain | 1409 | AIG1 | Exon+ve, ≥2 cases | Yes |
| 6 | 141 | 143693693 | 143696258 | 2565 | gain | 1619 | AIG1 | Exon+ve, ≥2 cases | Yes |
| 6 | 141 | 143693693 | 143696258 | 2565 | gain | 1639 | AIG1 | Exon+ve, ≥2 cases | Yes |
| 6 | 142 | 143696259 | 143697901 | 1642 | gain | 1281 | AIG1 | Exon+ve, ≥2 cases | Yes |
| 6 | 142 | 143696259 | 143697901 | 1642 | gain | 1372 | AIG1 | Exon+ve, ≥2 cases | Yes |
| 6 | 142 | 143696259 | 143697901 | 1642 | gain | 1409 | AIG1 | Exon+ve, ≥2 cases | Yes |
| 6 | 142 | 143696259 | 143697901 | 1642 | gain | 1619 | AIG1 | Exon+ve, ≥2 cases | Yes |
| 6 | 142 | 143696259 | 143697901 | 1642 | gain | 1639 | AIG1 | Exon+ve, ≥2 cases | Yes |
| 6 | 142 | 143696259 | 143697901 | 1642 | gain | 1429 | AIG1 | Exon+ve, ≥2 cases | Yes |
| 6 | 142 | 143696259 | 143697901 | 1642 | gain | 1905 | AIG1 | Exon+ve, ≥2 cases | Yes |
| 6 | 142 | 143696259 | 143697901 | 1642 | gain | 1926 | AIG1 | Exon+ve, ≥2 cases | Yes |
| 6 | 143 | 143697902 | 143705189 | 7287 | gain | 1281 | AIG1 | Exon+ve, ≥2 cases | Yes |
| 6 | 143 | 143697902 | 143705189 | 7287 | gain | 1372 | AIG1 | Exon+ve, ≥2 cases | Yes |
| 6 | 143 | 143697902 | 143705189 | 7287 | gain | 1409 | AIG1 | Exon+ve, ≥2 cases | Yes |
| 6 | 143 | 143697902 | 143705189 | 7287 | gain | 1429 | AIG1 | Exon+ve, ≥2 cases | Yes |
| 6 | 143 | 143697902 | 143705189 | 7287 | gain | 1619 | AIG1 | Exon+ve, ≥2 cases | Yes |
| 6 | 143 | 143697902 | 143705189 | 7287 | gain | 1639 | AIG1 | Exon+ve, ≥2 cases | Yes |
| 6 | 143 | 143697902 | 143705189 | 7287 | gain | 1905 | AIG1 | Exon+ve, ≥2 cases | Yes |
| 6 | 143 | 143697902 | 143705189 | 7287 | gain | 1926 | AIG1 | Exon+ve, ≥2 cases | Yes |
| 6 | 144 | 146912375 | 146914496 | 2121 | loss | 1291 | RAB32 | Exon+ve, ≥2 cases | Yes |
| 6 | 144 | 146912375 | 146914496 | 2121 | loss | 1309 | RAB32 | Exon+ve, ≥2 cases | Yes |
| 6 | 144 | 146912375 | 146914496 | 2121 | loss | 1535 | RAB32 | Exon+ve, ≥2 cases | Yes |
| 6 | 145 | 149109599 | 149110881 | 1282 | loss | 1369 | UST | Exon+ve, ≥2 cases | Yes |
| 6 | 145 | 149109599 | 149110881 | 1282 | loss | 1645 | UST | Exon+ve, ≥2 cases | Yes |
| 6 | 145 | 149109599 | 149110881 | 1282 | loss | 1660 | UST | Exon+ve, ≥2 cases | Yes |
| 6 | 146 | 155530613 | 155545570 | 14957 | loss | 1347 | TIAM2 | Exon+ve, ≥2 cases | Yes |
| 6 | 146 | 155530613 | 155545570 | 14957 | loss | 1598 | TIAM2 | Exon+ve, ≥2 cases | Yes |
| 6 | 147 | 159190838 | 159203355 | 12517 | loss | 1468 | OSTCL | Exon+ve, ≥2 cases | Yes |
| 6 | 147 | 159190838 | 159203355 | 12517 | loss | 1582 | OSTCL | Exon+ve, ≥2 cases | Yes |
| 6 | 148 | 159234892 | 159238587 | 3695 | loss | 1419 | C6orf99 | Exon+ve, ≥2 cases | Yes |
| 6 | 148 | 159234892 | 159238587 | 3695 | loss | 1468 | C6orf99 | Exon+ve, ≥2 cases | Yes |
| 6 | 148 | 159234892 | 159238587 | 3695 | loss | 1742 | C6orf99 | Exon+ve, ≥2 cases | Yes |
| 6 | 148 | 159234892 | 159238587 | 3695 | loss | 1900 | C6orf99 | Exon+ve, ≥2 cases | Yes |
| 6 | 148 | 160247865 | 160248266 | 401 | gain | 1242 | MAS1 | Exon+ve, ≥2 cases | Yes |
| 6 | 148 | 160247865 | 160248266 | 401 | gain | 1571 | MAS1 | Exon+ve, ≥2 cases | Yes |
| 6 | 148 | 160247865 | 160248266 | 401 | gain | 1574 | MAS1 | Exon+ve, ≥2 cases | Yes |
| 6 | 148 | 160247865 | 160248266 | 401 | gain | 1870 | MAS1 | Exon+ve, ≥2 cases | Yes |
| 6 | 149 | 165748837 | 165755595 | 6758 | loss | 1590 | PDE10A | Exon+ve, ≥2 cases | Yes |
| 6 | 149 | 165748837 | 165755595 | 6758 | gain | 1760 | PDE10A | Exon+ve, ≥2 cases | Yes |
| 6 | 150 | 166487200 | 166494679 | 7479 | gain | 1392 | T | Exon+ve, distinct | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 6 | 151 | 166499289 | 166503493 | 4204 | loss | 1859 | T | CNVs, same Gene | Yes |
| 6 | 152 | 170683495 | 170701779 | 18284 | gain | 1729 | PSMB1 | Exon+ve, distinct | Yes |
| 6 | 152 | 170683495 | 170701779 | 18284 | gain | 1954 | PSMB1 | CNVs, same Gene | Yes |
| 7 | 153 | 6004111 | 6006782 | 2671 | gain | 1266 | PMS2 | Exon+ve, ≥2 cases | Yes |
| 7 | 153 | 6004111 | 6006782 | 2671 | gain | 1938 | PMS2 | Exon+ve, ≥2 cases | Yes |
| 7 | 154 | 45079997 | 45096030 | 16033 | loss | 1642 | NACAD, CCM2 | Exon+ve, ≥2 cases | Yes |
| 7 | 154 | 45079997 | 45096030 | 16033 | loss | 1819 | NACAD, CCM2 | Exon+ve, ≥2 cases | Yes |
| 7 | 154 | 45079997 | 45096030 | 16033 | loss | 1825 | NACAD, CCM2 | Exon+ve, ≥2 cases | Yes |
| 7 | 154 | 45079997 | 45096030 | 16033 | loss | 1907 | NACAD, CCM2 | Exon+ve, ≥2 cases | Yes |
| 7 | 155 | 48528408 | 48532031 | 3623 | loss | 1886 | ABCA13 | Exon+ve, ≥2 cases | Yes |
| 7 | 155 | 48528408 | 48532031 | 3623 | loss | 1891 | ABCA13 | Exon+ve, distinct | Yes |
| 7 | 156 | 86932062 | 86941683 | 9621 | loss | 1439 | ABCB4 | Exon+ve, ≥2 cases | Yes |
| 7 | 156 | 86932062 | 86941683 | 9621 | loss | 1579 | ABCB4 | Exon+ve, ≥2 cases | Yes |
| 7 | 157 | 89728688 | 89820179 | 91491 | gain | 1274 | GTPBP10, C7orf63 | Exon+ve, distinct | Yes |
| 7 | 158 | 89824673 | 89852155 | 27482 | gain | 1864 | GTPBP10 | CNVs, same Gene | Yes |
| 7 | 159 | 91585706 | 91605955 | 20249 | loss | 1734 | CYP51A1 | Exon+ve, ≥2 cases | Yes |
| 7 | 159 | 91585706 | 91605955 | 20249 | loss | 1856 | CYP51A1 | Exon+ve, ≥2 cases | Yes |
| 7 | 160 | 99031711 | 99035131 | 3420 | gain | 1411 | LOC100289187 | Exon+ve, ≥2 cases | Yes |
| 7 | 160 | 99031711 | 99035131 | 3420 | gain | 1755 | LOC100289187 | Exon+ve, ≥2 cases | Yes |
| 7 | 160 | 99031711 | 99035131 | 3420 | gain | 1799 | LOC100289187 | Exon+ve, ≥2 cases | Yes |
| 7 | 161 | 100182351 | 100183859 | 1508 | loss | 1227 | ZAN | Exon+ve, ≥2 cases | Yes |
| 7 | 161 | 100182351 | 100183859 | 1508 | loss | 1236 | ZAN | Exon+ve, ≥2 cases | Yes |
| 7 | 161 | 100182351 | 100183859 | 1508 | loss | 1803 | ZAN | Exon+ve, ≥2 cases | Yes |
| 7 | 161 | 100182351 | 100183859 | 1508 | loss | 1824 | ZAN | Exon+ve, ≥2 cases | Yes |
| 7 | 161 | 100182351 | 100183859 | 1508 | loss | 1896 | ZAN | Exon+ve, ≥2 cases | Yes |
| 7 | 161 | 100182351 | 100183859 | 1508 | loss | 2034 | ZAN | Exon+ve, ≥2 cases | Yes |
| 7 | 162 | 100967884 | 100979053 | 11169 | loss | 1680 | EMID2 | Exon+ve, ≥2 cases | Yes |
| 7 | 162 | 100967884 | 100979053 | 11169 | loss | 1820 | EMID2 | Exon+ve, ≥2 cases | Yes |
| 7 | 163 | 107049716 | 107067706 | 17990 | loss | 1321 | BCAP29 | Exon+ve, ≥2 cases | Yes |
| 7 | 163 | 107049716 | 107067706 | 17990 | loss | 1475 | BCAP29 | Exon+ve, ≥2 cases | Yes |
| 7 | 164 | 122003026 | 122010979 | 7953 | loss | 1910 | CADPS2 | Exon+ve, distinct | Yes |
| 7 | 165 | 122051537 | 122056508 | 4971 | loss | 1354 | CADPS2 | CNVs, same Gene | Yes |
| 7 | 166 | 127640643 | 127675911 | 35268 | gain | 1266 | LEP | Exon+ve, distinct | Yes |
| 7 | 166 | 127640643 | 127675911 | 35268 | gain | 1733 | LEP | CNVs, same Gene | Yes |
| 7 | 167 | 133906667 | 133908027 | 1360 | gain | 1494 | AKR1B15 | Exon+ve, ≥2 cases | Yes |
| 7 | 167 | 133906667 | 133908027 | 1360 | gain | 1783 | AKR1B15 | Exon+ve, ≥2 cases | Yes |
| 7 | 168 | 141443578 | 141446728 | 3150 | gain | 1220 | MGAM | Exon+ve, ≥2 cases | Yes |
| 7 | 168 | 141443578 | 141446728 | 3150 | gain | 1225 | MGAM | Exon+ve, ≥2 cases | Yes |
| 7 | 168 | 142041787 | 142083554 | 41767 | loss | 1232 | MTRNR2L6 | Exon+ve, ≥2 cases | Yes |
| 7 | 168 | 142041787 | 142083554 | 41767 | loss | 1242 | MTRNR2L6 | Exon+ve, ≥2 cases | Yes |
| 7 | 168 | 142041787 | 142083554 | 41767 | loss | 1347 | MTRNR2L6 | Exon+ve, ≥2 cases | Yes |
| 7 | 168 | 142041787 | 142083554 | 41767 | loss | 1349 | MTRNR2L6 | Exon+ve, ≥2 cases | Yes |
| 7 | 168 | 142041787 | 142083554 | 41767 | loss | 1374 | MTRNR2L6 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 7 | 168 | 142041787 | 142083554 | 41767 | loss | 1568 | MTRNR2L6 | Exon+ve, ≥2 cases | Yes |
| 7 | 168 | 142041787 | 142083554 | 41767 | loss | 1601 | MTRNR2L6 | Exon+ve, ≥2 cases | Yes |
| 7 | 168 | 142041787 | 142083554 | 41767 | loss | 1697 | MTRNR2L6 | Exon+ve, ≥2 cases | Yes |
| 7 | 168 | 142041787 | 142083554 | 41767 | loss | 1753 | MTRNR2L6 | Exon+ve, ≥2 cases | Yes |
| 7 | 168 | 142041787 | 142083554 | 41767 | loss | 1784 | MTRNR2L6 | Exon+ve, ≥2 cases | Yes |
| 7 | 168 | 142041787 | 142083554 | 41767 | loss | 1803 | MTRNR2L6 | Exon+ve, ≥2 cases | Yes |
| 7 | 168 | 142041787 | 142083554 | 41767 | loss | 1837 | MTRNR2L6 | Exon+ve, ≥2 cases | Yes |
| 7 | 168 | 142041787 | 142083554 | 41767 | loss | 1930 | MTRNR2L6 | Exon+ve, ≥2 cases | Yes |
| 7 | 168 | 142041787 | 142083554 | 41767 | loss | 2018 | MTRNR2L6 | Exon+ve, ≥2 cases | Yes |
| 7 | 168 | 142041787 | 142083554 | 41767 | loss | 2024 | MTRNR2L6 | Exon+ve, ≥2 cases | Yes |
| 7 | 169 | 147702365 | 147710037 | 7672 | Loss | 1728 | CNTNAP2 | Ctrl pos High OR | No |
| 7 | 170 | 147704200 | 147710037 | 5837 | Loss | 1227 | CNTNAP2 | Ctrl pos High OR | No |
| 7 | 170 | 147704200 | 147710037 | 5837 | Loss | 1346 | CNTNAP2 | Ctrl pos High OR | No |
| 7 | 170 | 147704200 | 147708382 | 4182 | Loss | 1371 | CNTNAP2 | Ctrl pos High OR | No |
| 7 | 170 | 147704200 | 147710037 | 5837 | Loss | 1517 | CNTNAP2 | Ctrl pos High OR | No |
| 7 | 170 | 147704200 | 147708382 | 4182 | Loss | 1617 | CNTNAP2 | Ctrl pos High OR | No |
| 7 | 170 | 147704200 | 147710037 | 5837 | Loss | 1621 | CNTNAP2 | Ctrl pos High OR | No |
| 7 | 170 | 147704200 | 147710037 | 5837 | Loss | 1636 | CNTNAP2 | Ctrl pos High OR | No |
| 7 | 170 | 147704200 | 147710037 | 5837 | Loss | 1639 | CNTNAP2 | Ctrl pos High OR | No |
| 7 | 170 | 147704200 | 147710037 | 5837 | Loss | 1645 | CNTNAP2 | Ctrl pos High OR | No |
| 7 | 170 | 147704200 | 147710037 | 5837 | Loss | 1670 | CNTNAP2 | Ctrl pos High OR | No |
| 7 | 170 | 147704200 | 147710037 | 5837 | Loss | 1727 | CNTNAP2 | Ctrl pos High OR | No |
| 7 | 170 | 147704200 | 147710037 | 5837 | Loss | 1753 | CNTNAP2 | Ctrl pos High OR | No |
| 7 | 170 | 147704200 | 147710037 | 5837 | Loss | 1754 | CNTNAP2 | Ctrl pos High OR | No |
| 7 | 170 | 147704200 | 147710037 | 5837 | Loss | 1761 | CNTNAP2 | Ctrl pos High OR | No |
| 7 | 170 | 147704200 | 147710037 | 5837 | Loss | 1792 | CNTNAP2 | Ctrl pos High OR | No |
| 7 | 170 | 147704200 | 147710037 | 5837 | Loss | 1803 | CNTNAP2 | Ctrl pos High OR | No |
| 7 | 170 | 147704200 | 147710037 | 5837 | Loss | 1806 | CNTNAP2 | Ctrl pos High OR | No |
| 7 | 170 | 147704200 | 147710037 | 5837 | Loss | 1820 | CNTNAP2 | Ctrl pos High OR | No |
| 7 | 170 | 147704200 | 147710037 | 5837 | Loss | 1826 | CNTNAP2 | Ctrl pos High OR | No |
| 7 | 170 | 147704200 | 147710037 | 5837 | Loss | 1836 | CNTNAP2 | Ctrl pos High OR | No |
| 7 | 170 | 147704200 | 147710037 | 5837 | Loss | 1854 | CNTNAP2 | Ctrl pos High OR | No |
| 7 | 170 | 147704200 | 147710037 | 5837 | Loss | 1867 | CNTNAP2 | Ctrl pos High OR | No |
| 7 | 170 | 147704200 | 147710037 | 5837 | Loss | 1872 | CNTNAP2 | Ctrl pos High OR | No |
| 7 | 170 | 147704200 | 147710037 | 5837 | Loss | 1916 | CNTNAP2 | Ctrl pos High OR | No |
| 7 | 170 | 147704200 | 147710037 | 5837 | Loss | 1918 | CNTNAP2 | Ctrl pos High OR | No |
| 7 | 170 | 147704200 | 147710037 | 5837 | Loss | 1960 | CNTNAP2 | Ctrl pos High OR | No |
| 7 | 170 | 147704200 | 147710037 | 5837 | Loss | 2003 | CNTNAP2 | Ctrl pos High OR | No |
| 7 | 170 | 147704200 | 147710037 | 5837 | Loss | 2028 | CNTNAP2 | Ctrl pos High OR | No |
| 7 | 170 | 147704200 | 147710037 | 5837 | Loss | 2041 | CNTNAP2 | Ctrl pos High OR | No |
| 7 | 170 | 147704200 | 147708382 | 4182 | Gain | 1220 | CNTNAP2 | Ctrl pos High OR | No |
| 7 | 170 | 147704200 | 147708382 | 4182 | Gain | 1223 | CNTNAP2 | Ctrl pos High OR | No |
| 7 | 170 | 147704200 | 147708382 | 4182 | Gain | 1230 | CNTNAP2 | Ctrl pos High OR | No |
| 7 | 170 | 147704200 | 147708382 | 4182 | Gain | 1234 | CNTNAP2 | Ctrl pos High OR | No |
| 7 | 170 | 147704200 | 147708382 | 4182 | Gain | 1240 | CNTNAP2 | Ctrl pos High OR | No |
| 7 | 170 | 147704200 | 147708382 | 4182 | Gain | 1252 | CNTNAP2 | Ctrl pos High OR | No |
| 7 | 170 | 147704200 | 147708382 | 4182 | Gain | 1281 | CNTNAP2 | Ctrl pos High OR | No |
| 7 | 170 | 147704200 | 147708382 | 4182 | Gain | 1282 | CNTNAP2 | Ctrl pos High OR | No |
| 7 | 170 | 147704200 | 147708382 | 4182 | Gain | 1284 | CNTNAP2 | Ctrl pos High OR | No |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 7 | 170 | 147704200 | 147708382 | 4182 | Gain | 1286 | CNTNAP2 | Ctrl pos High OR | No |
| 7 | 170 | 147704200 | 147708382 | 4182 | Gain | 1290 | CNTNAP2 | Ctrl pos High OR | No |
| 7 | 170 | 147704200 | 147708382 | 4182 | Gain | 1307 | CNTNAP2 | Ctrl pos High OR | No |
| 7 | 170 | 147704200 | 147708382 | 4182 | Gain | 1308 | CNTNAP2 | Ctrl pos High OR | No |
| 7 | 170 | 147704200 | 147708382 | 4182 | Gain | 1309 | CNTNAP2 | Ctrl pos High OR | No |
| 7 | 170 | 147704200 | 147708382 | 4182 | Gain | 1318 | CNTNAP2 | Ctrl pos High OR | No |
| 7 | 170 | 147704200 | 147708382 | 4182 | Gain | 1320 | CNTNAP2 | Ctrl pos High OR | No |
| 7 | 170 | 147704200 | 147708382 | 4182 | Gain | 1345 | CNTNAP2 | Ctrl pos High OR | No |
| 7 | 170 | 147704200 | 147708382 | 4182 | Gain | 1389 | CNTNAP2 | Ctrl pos High OR | No |
| 7 | 170 | 147704200 | 147708382 | 4182 | Gain | 1405 | CNTNAP2 | Ctrl pos High OR | No |
| 7 | 170 | 147704200 | 147708382 | 4182 | Gain | 1415 | CNTNAP2 | Ctrl pos High OR | No |
| 7 | 170 | 147704200 | 147708382 | 4182 | Gain | 1421 | CNTNAP2 | Ctrl pos High OR | No |
| 7 | 170 | 147704200 | 147708382 | 4182 | Gain | 1422 | CNTNAP2 | Ctrl pos High OR | No |
| 7 | 170 | 147704200 | 147711471 | 7271 | Gain | 1423 | CNTNAP2 | Ctrl pos High OR | No |
| 7 | 170 | 147704200 | 147708382 | 4182 | Gain | 1425 | CNTNAP2 | Ctrl pos High OR | No |
| 7 | 170 | 147704200 | 147708382 | 4182 | Gain | 1432 | CNTNAP2 | Ctrl pos High OR | No |
| 7 | 170 | 147704200 | 147708382 | 4182 | Gain | 1434 | CNTNAP2 | Ctrl pos High OR | No |
| 7 | 170 | 147704200 | 147708382 | 4182 | Gain | 1438 | CNTNAP2 | Ctrl pos High OR | No |
| 7 | 170 | 147704200 | 147708382 | 4182 | Gain | 1440 | CNTNAP2 | Ctrl pos High OR | No |
| 7 | 170 | 147704200 | 147708382 | 4182 | Gain | 1442 | CNTNAP2 | Ctrl pos High OR | No |
| 7 | 170 | 147704200 | 147708382 | 4182 | Gain | 1463 | CNTNAP2 | Ctrl pos High OR | No |
| 7 | 170 | 147704200 | 147708382 | 4182 | Gain | 1466 | CNTNAP2 | Ctrl pos High OR | No |
| 7 | 170 | 147704200 | 147708382 | 4182 | Gain | 1472 | CNTNAP2 | Ctrl pos High OR | No |
| 7 | 170 | 147704200 | 147708382 | 4182 | Gain | 1473 | CNTNAP2 | Ctrl pos High OR | No |
| 7 | 170 | 147704200 | 147708382 | 4182 | Gain | 1490 | CNTNAP2 | Ctrl pos High OR | No |
| 7 | 170 | 147704200 | 147708382 | 4182 | Gain | 1492 | CNTNAP2 | Ctrl pos High OR | No |
| 7 | 170 | 147704200 | 147708382 | 4182 | Gain | 1495 | CNTNAP2 | Ctrl pos High OR | No |
| 7 | 170 | 147704200 | 147708382 | 4182 | Gain | 1496 | CNTNAP2 | Ctrl pos High OR | No |
| 7 | 170 | 147704200 | 147708382 | 4182 | Gain | 1497 | CNTNAP2 | Ctrl pos High OR | No |
| 7 | 170 | 147704200 | 147708382 | 4182 | Gain | 1498 | CNTNAP2 | Ctrl pos High OR | No |
| 7 | 170 | 147704200 | 147708382 | 4182 | Gain | 1502 | CNTNAP2 | Ctrl pos High OR | No |
| 7 | 170 | 147704200 | 147708382 | 4182 | Gain | 1504 | CNTNAP2 | Ctrl pos High OR | No |
| 7 | 170 | 147704200 | 147708382 | 4182 | Gain | 1506 | CNTNAP2 | Ctrl pos High OR | No |
| 7 | 170 | 147704200 | 147708382 | 4182 | Gain | 1508 | CNTNAP2 | Ctrl pos High OR | No |
| 7 | 170 | 147704200 | 147708382 | 4182 | Gain | 1512 | CNTNAP2 | Ctrl pos High OR | No |
| 7 | 170 | 147704200 | 147708382 | 4182 | Gain | 1513 | CNTNAP2 | Ctrl pos High OR | No |
| 7 | 170 | 147704200 | 147708382 | 4182 | Gain | 1514 | CNTNAP2 | Ctrl pos High OR | No |
| 7 | 170 | 147704200 | 147708382 | 4182 | Gain | 1515 | CNTNAP2 | Ctrl pos High OR | No |
| 7 | 170 | 147704200 | 147708382 | 4182 | Gain | 1519 | CNTNAP2 | Ctrl pos High OR | No |
| 7 | 170 | 147704200 | 147708382 | 4182 | Gain | 1520 | CNTNAP2 | Ctrl pos High OR | No |
| 7 | 170 | 147704200 | 147708382 | 4182 | Gain | 1528 | CNTNAP2 | Ctrl pos High OR | No |
| 7 | 170 | 147704200 | 147708382 | 4182 | Gain | 1534 | CNTNAP2 | Ctrl pos High OR | No |
| 7 | 170 | 147704200 | 147708382 | 4182 | Gain | 1543 | CNTNAP2 | Ctrl pos High OR | No |
| 7 | 170 | 147704200 | 147708382 | 4182 | Gain | 1544 | CNTNAP2 | Ctrl pos High OR | No |
| 7 | 170 | 147704200 | 147708382 | 4182 | Gain | 1556 | CNTNAP2 | Ctrl pos High OR | No |
| 7 | 170 | 147704200 | 147708382 | 4182 | Gain | 1557 | CNTNAP2 | Ctrl pos High OR | No |
| 7 | 170 | 147704200 | 147708382 | 4182 | Gain | 1558 | CNTNAP2 | Ctrl pos High OR | No |
| 7 | 170 | 147704200 | 147708382 | 4182 | Gain | 1559 | CNTNAP2 | Ctrl pos High OR | No |
| 7 | 170 | 147704200 | 147708382 | 4182 | Gain | 1560 | CNTNAP2 | Ctrl pos High OR | No |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 7 | 170 | 147704200 | 147708382 | 4182 | Gain | 1565 | CNTNAP2 | Ctrl pos High OR | No |
| 7 | 170 | 147704200 | 147708382 | 4182 | Gain | 1570 | CNTNAP2 | Ctrl pos High OR | No |
| 7 | 170 | 147704200 | 147708382 | 4182 | Gain | 1571 | CNTNAP2 | Ctrl pos High OR | No |
| 7 | 170 | 147704200 | 147708382 | 4182 | Gain | 1573 | CNTNAP2 | Ctrl pos High OR | No |
| 7 | 170 | 147704200 | 147708382 | 4182 | Gain | 1584 | CNTNAP2 | Ctrl pos High OR | No |
| 7 | 170 | 147704200 | 147708382 | 4182 | Gain | 1586 | CNTNAP2 | Ctrl pos High OR | No |
| 7 | 170 | 147704200 | 147708382 | 4182 | Gain | 1592 | CNTNAP2 | Ctrl pos High OR | No |
| 7 | 170 | 147704200 | 147708382 | 4182 | Gain | 1597 | CNTNAP2 | Ctrl pos High OR | No |
| 7 | 170 | 147704200 | 147708382 | 4182 | Gain | 1601 | CNTNAP2 | Ctrl pos High OR | No |
| 7 | 170 | 147704200 | 147708382 | 4182 | Gain | 1602 | CNTNAP2 | Ctrl pos High OR | No |
| 7 | 170 | 147704200 | 147708382 | 4182 | Gain | 1603 | CNTNAP2 | Ctrl pos High OR | No |
| 7 | 170 | 147704200 | 147708382 | 4182 | Gain | 1610 | CNTNAP2 | Ctrl pos High OR | No |
| 7 | 170 | 147704200 | 147708382 | 4182 | Gain | 1618 | CNTNAP2 | Ctrl pos High OR | No |
| 7 | 170 | 147704200 | 147708382 | 4182 | Gain | 1619 | CNTNAP2 | Ctrl pos High OR | No |
| 7 | 170 | 147704200 | 147708382 | 4182 | Gain | 1620 | CNTNAP2 | Ctrl pos High OR | No |
| 7 | 170 | 147704200 | 147708382 | 4182 | Gain | 1622 | CNTNAP2 | Ctrl pos High OR | No |
| 7 | 170 | 147704200 | 147708382 | 4182 | Gain | 1624 | CNTNAP2 | Ctrl pos High OR | No |
| 7 | 170 | 147704200 | 147708382 | 4182 | Gain | 1626 | CNTNAP2 | Ctrl pos High OR | No |
| 7 | 170 | 147704200 | 147708382 | 4182 | Gain | 1632 | CNTNAP2 | Ctrl pos High OR | No |
| 7 | 170 | 147704200 | 147708382 | 4182 | Gain | 1640 | CNTNAP2 | Ctrl pos High OR | No |
| 7 | 170 | 147704200 | 147708382 | 4182 | Gain | 1641 | CNTNAP2 | Ctrl pos High OR | No |
| 7 | 170 | 147704200 | 147708382 | 4182 | Gain | 1647 | CNTNAP2 | Ctrl pos High OR | No |
| 7 | 170 | 147704200 | 147708382 | 4182 | Gain | 1650 | CNTNAP2 | Ctrl pos High OR | No |
| 7 | 170 | 147704200 | 147708382 | 4182 | Gain | 1653 | CNTNAP2 | Ctrl pos High OR | No |
| 7 | 170 | 147704200 | 147708382 | 4182 | Gain | 1654 | CNTNAP2 | Ctrl pos High OR | No |
| 7 | 170 | 147704200 | 147708382 | 4182 | Gain | 1662 | CNTNAP2 | Ctrl pos High OR | No |
| 7 | 170 | 147704200 | 147708382 | 4182 | Gain | 1667 | CNTNAP2 | Ctrl pos High OR | No |
| 7 | 170 | 147704200 | 147708382 | 4182 | Gain | 1688 | CNTNAP2 | Ctrl pos High OR | No |
| 7 | 170 | 147704200 | 147708382 | 4182 | Gain | 1707 | CNTNAP2 | Ctrl pos High OR | No |
| 7 | 170 | 147704200 | 147708382 | 4182 | Gain | 1708 | CNTNAP2 | Ctrl pos High OR | No |
| 7 | 170 | 147704200 | 147708382 | 4182 | Gain | 1710 | CNTNAP2 | Ctrl pos High OR | No |
| 7 | 170 | 147704200 | 147708382 | 4182 | Gain | 1715 | CNTNAP2 | Ctrl pos High OR | No |
| 7 | 170 | 147704200 | 147708382 | 4182 | Gain | 1720 | CNTNAP2 | Ctrl pos High OR | No |
| 7 | 170 | 147704200 | 147708382 | 4182 | Gain | 1755 | CNTNAP2 | Ctrl pos High OR | No |
| 7 | 170 | 147704200 | 147708382 | 4182 | Gain | 1760 | CNTNAP2 | Ctrl pos High OR | No |
| 7 | 170 | 147704200 | 147708382 | 4182 | Gain | 1774 | CNTNAP2 | Ctrl pos High OR | No |
| 7 | 170 | 147704200 | 147708382 | 4182 | Gain | 1779 | CNTNAP2 | Ctrl pos High OR | No |
| 7 | 170 | 147704200 | 147708382 | 4182 | Gain | 1782 | CNTNAP2 | Ctrl pos High OR | No |
| 7 | 170 | 147704200 | 147708382 | 4182 | Gain | 1783 | CNTNAP2 | Ctrl pos High OR | No |
| 7 | 170 | 147704200 | 147708382 | 4182 | Gain | 1784 | CNTNAP2 | Ctrl pos High OR | No |
| 7 | 170 | 147704200 | 147708382 | 4182 | Gain | 1796 | CNTNAP2 | Ctrl pos High OR | No |
| 7 | 170 | 147704200 | 147708382 | 4182 | Gain | 1804 | CNTNAP2 | Ctrl pos High OR | No |
| 7 | 170 | 147704200 | 147708382 | 4182 | Gain | 1805 | CNTNAP2 | Ctrl pos High OR | No |
| 7 | 170 | 147704200 | 147707161 | 2961 | Gain | 1808 | CNTNAP2 | Ctrl pos High OR | No |
| 7 | 170 | 147704200 | 147708382 | 4182 | Gain | 1811 | CNTNAP2 | Ctrl pos High OR | No |
| 7 | 170 | 147704200 | 147708382 | 4182 | Gain | 1813 | CNTNAP2 | Ctrl pos High OR | No |
| 7 | 170 | 147704200 | 147708382 | 4182 | Gain | 1814 | CNTNAP2 | Ctrl pos High OR | No |
| 7 | 170 | 147704200 | 147708382 | 4182 | Gain | 1815 | CNTNAP2 | Ctrl pos High OR | No |
| 7 | 170 | 147704200 | 147708382 | 4182 | Gain | 1818 | CNTNAP2 | Ctrl pos High OR | No |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 7 | 170 | 147704200 | 147708382 | 4182 | Gain | 1831 | CNTNAP2 | Ctrl pos High OR | No |
| 7 | 170 | 147704200 | 147708382 | 4182 | Gain | 1832 | CNTNAP2 | Ctrl pos High OR | No |
| 7 | 170 | 147704200 | 147708382 | 4182 | Gain | 1835 | CNTNAP2 | Ctrl pos High OR | No |
| 7 | 170 | 147704200 | 147708382 | 4182 | Gain | 1838 | CNTNAP2 | Ctrl pos High OR | No |
| 7 | 170 | 147704200 | 147708382 | 4182 | Gain | 1839 | CNTNAP2 | Ctrl pos High OR | No |
| 7 | 170 | 147704200 | 147708382 | 4182 | Gain | 1845 | CNTNAP2 | Ctrl pos High OR | No |
| 7 | 170 | 147704200 | 147708382 | 4182 | Gain | 1851 | CNTNAP2 | Ctrl pos High OR | No |
| 7 | 170 | 147704200 | 147708382 | 4182 | Gain | 1861 | CNTNAP2 | Ctrl pos High OR | No |
| 7 | 170 | 147704200 | 147708382 | 4182 | Gain | 1874 | CNTNAP2 | Ctrl pos High OR | No |
| 7 | 170 | 147704200 | 147707161 | 2961 | Gain | 1877 | CNTNAP2 | Ctrl pos High OR | No |
| 7 | 170 | 147704200 | 147708382 | 4182 | Gain | 1881 | CNTNAP2 | Ctrl pos High OR | No |
| 7 | 170 | 147704200 | 147708382 | 4182 | Gain | 1883 | CNTNAP2 | Ctrl pos High OR | No |
| 7 | 170 | 147704200 | 147708382 | 4182 | Gain | 1893 | CNTNAP2 | Ctrl pos High OR | No |
| 7 | 170 | 147704200 | 147707161 | 2961 | Gain | 1895 | CNTNAP2 | Ctrl pos High OR | No |
| 7 | 170 | 147704200 | 147708382 | 4182 | Gain | 1905 | CNTNAP2 | Ctrl pos High OR | No |
| 7 | 170 | 147704200 | 147707161 | 2961 | Gain | 1907 | CNTNAP2 | Ctrl pos High OR | No |
| 7 | 170 | 147704200 | 147708382 | 4182 | Gain | 1927 | CNTNAP2 | Ctrl pos High OR | No |
| 7 | 170 | 147704200 | 147708382 | 4182 | Gain | 1930 | CNTNAP2 | Ctrl pos High OR | No |
| 7 | 170 | 147704200 | 147708382 | 4182 | Gain | 1944 | CNTNAP2 | Ctrl pos High OR | No |
| 7 | 170 | 147704200 | 147708382 | 4182 | Gain | 1948 | CNTNAP2 | Ctrl pos High OR | No |
| 7 | 170 | 147704200 | 147707161 | 2961 | Gain | 1951 | CNTNAP2 | Ctrl pos High OR | No |
| 7 | 170 | 147704200 | 147708382 | 4182 | Gain | 1970 | CNTNAP2 | Ctrl pos High OR | No |
| 7 | 170 | 147704200 | 147707161 | 2961 | Gain | 1994 | CNTNAP2 | Ctrl pos High OR | No |
| 7 | 170 | 147704200 | 147708382 | 4182 | Gain | 1997 | CNTNAP2 | Ctrl pos High OR | No |
| 7 | 170 | 147704200 | 147707161 | 2961 | Gain | 2006 | CNTNAP2 | Ctrl pos High OR | No |
| 7 | 170 | 147704200 | 147708382 | 4182 | Gain | 2024 | CNTNAP2 | Ctrl pos High OR | No |
| 7 | 170 | 147704200 | 147708382 | 4182 | Gain | 2026 | CNTNAP2 | Ctrl pos High OR | No |
| 7 | 170 | 147704200 | 147708382 | 4182 | Gain | 2034 | CNTNAP2 | Ctrl pos High OR | No |
| 7 | 171 | 147734925 | 147737360 | 2435 | loss | 1346 | CNTNAP2 | Exon+ve, ≥2 cases | Yes |
| 7 | 171 | 147734925 | 147737360 | 2435 | loss | 1403 | CNTNAP2 | Exon+ve, ≥2 cases | Yes |
| 7 | 171 | 147734925 | 147737360 | 2435 | loss | 1988 | CNTNAP2 | Exon+ve, ≥2 cases | Yes |
| 7 | 172 | 153158956 | 153290833 | 131877 | gain | 1486 | DPP6 | Exon+ve, ≥2 cases | Yes |
| 7 | 172 | 153158956 | 153290833 | 131877 | gain | 1730 | DPP6 | Exon+ve, ≥2 cases | Yes |
| 7 | 172 | 153158956 | 153290833 | 131877 | gain | 1755 | DPP6 | Exon+ve, ≥2 cases | Yes |
| 7 | 173 | 153290834 | 153384745 | 93911 | gain | 1730 | DPP6 | Exon+ve, ≥2 cases | Yes |
| 7 | 173 | 153290834 | 153384745 | 93911 | gain | 1755 | DPP6 | Exon+ve, ≥2 cases | Yes |
| 7 | 174 | 153742206 | 153775545 | 33339 | gain | 1730 | DPP6 | Exon+ve, ≥2 cases | Yes |
| 7 | 174 | 153742206 | 153775545 | 33339 | loss | 1885 | DPP6 | Exon+ve, ≥2 cases | Yes |
| 7 | 175 | 153798366 | 153819463 | 21097 | gain | 1730 | DPP6 | Exon+ve, ≥2 cases | Yes |
| 7 | 175 | 153798366 | 153819463 | 21097 | loss | 1949 | DPP6 | Exon+ve, ≥2 cases | Yes |
| 8 | 176 | 6718944 | 6779427 | 60483 | gain | 1572 | DEFA6, DEFB1 | Exon+ve, ≥2 cases | Yes |
| 8 | 176 | 6718944 | 6779427 | 60483 | loss | 1621 | DEFA6, DEFB1 | Exon+ve, ≥2 cases | Yes |
| 8 | 177 | 10658422 | 10666072 | 7650 | loss | 1663 | PINX1 | Exon+ve, ≥2 cases | Yes |
| 8 | 177 | 10658422 | 10666072 | 7650 | gain | 2042 | PINX1 | Exon+ve, ≥2 cases | Yes |
| 8 | 178 | 10670976 | 10732498 | 61522 | loss | 1663 | PINX1, MIR1322 | Exon+ve, ≥2 cases | Yes |
| 8 | 178 | 10670976 | 10732498 | 61522 | gain | 2042 | PINX1, MIR1322 | Exon+ve, ≥2 cases | Yes |
| 8 | 179 | 22631429 | 22641498 | 10069 | loss | 1293 | PEBP4 | Exon+ve, ≥2 cases | Yes |
| 8 | 179 | 22631429 | 22641498 | 10069 | loss | 1296 | PEBP4 | Exon+ve, ≥2 cases | Yes |
| 8 | 179 | 22631429 | 22641498 | 10069 | loss | 1842 | PEBP4 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 8 | 179 | 22631429 | 22641498 | 10069 | loss | 1849 | PEBP4 | Exon+ve, ≥2 cases | Yes |
| 8 | 180 | 42134084 | 42135245 | 1161 | loss | 1251 | AP3M2 | Exon+ve, distinct | Yes |
| | | | | | | | | CNVs, same Gene | |
| 8 | 181 | 42145982 | 42149494 | 3512 | gain | 1634 | AP3M2 | Exon+ve, distinct | Yes |
| | | | | | | | | CNVs, same Gene | |
| 8 | 182 | 43057445 | 43170237 | 112792 | gain | 1406 | HGSNAT, FNTA, SGK196 | Exon+ve, ≥2 cases | Yes |
| 8 | 182 | 43057445 | 43170237 | 112792 | gain | 1695 | HGSNAT, FNTA, SGK196 | Exon+ve, ≥2 cases | Yes |
| 8 | 183 | 43288182 | 43294454 | 6272 | gain | 1316 | POTEA | Exon+ve, ≥2 cases | Yes |
| 8 | 183 | 43288182 | 43294454 | 6272 | gain | 1406 | POTEA | Exon+ve, ≥2 cases | Yes |
| 8 | 183 | 43288182 | 43294454 | 6272 | loss | 1549 | POTEA | Exon+ve, ≥2 cases | Yes |
| 8 | 183 | 43288182 | 43294454 | 6272 | gain | 1695 | POTEA | Exon+ve, ≥2 cases | Yes |
| 8 | 184 | 54952820 | 54956193 | 3373 | loss | 1604 | RGS20 | Exon+ve, ≥2 cases | Yes |
| 8 | 184 | 54952820 | 54956193 | 3373 | loss | 1993 | RGS20 | Exon+ve, ≥2 cases | Yes |
| 8 | 185 | 67685665 | 67689015 | 3350 | loss | 1275 | MYBL1 | Exon+ve, ≥2 cases | Yes |
| 8 | 185 | 67685665 | 67689015 | 3350 | loss | 1650 | MYBL1 | Exon+ve, ≥2 cases | Yes |
| 8 | 186 | 82910933 | 82920255 | 9322 | loss | 1638 | SNX16 | Exon+ve, ≥2 cases | Yes |
| 8 | 186 | 82910933 | 82920255 | 9322 | loss | 1950 | SNX16 | Exon+ve, ≥2 cases | Yes |
| 8 | 187 | 134331224 | 134336458 | 5234 | gain | 1854 | NDRG1 | Exon+ve, distinct | Yes |
| | | | | | | | | CNVs, same Gene | |
| 8 | 188 | 134337809 | 134342059 | 4250 | loss | 1552 | NDRG1 | Exon+ve, distinct | Yes |
| | | | | | | | | CNVs, same Gene | |
| 9 | 189 | 5646415 | 5660083 | 13668 | gain | 1463 | KIAA1432 | Exon+ve, ≥2 cases | Yes |
| 9 | 189 | 5646415 | 5660083 | 13668 | gain | 1667 | KIAA1432 | Exon+ve, ≥2 cases | Yes |
| 9 | 189 | 5646415 | 5660083 | 13668 | gain | 1818 | KIAA1432 | Exon+ve, ≥2 cases | Yes |
| 9 | 190 | 6555187 | 6578755 | 23568 | loss | 1609 | GLDC | Exon+ve, distinct | Yes |
| | | | | | | | | CNVs, same Gene | |
| 9 | 191 | 6606637 | 6610662 | 4025 | loss | 1391 | GLDC | Exon+ve, distinct | Yes |
| | | | | | | | | CNVs, same Gene | |
| 9 | 192 | 15655922 | 15658483 | 2561 | loss | 1386 | C9orf93 | Exon+ve, ≥2 cases | Yes |
| 9 | 192 | 15655922 | 15658483 | 2561 | loss | 1477 | C9orf93 | Exon+ve, ≥2 cases | Yes |
| 9 | 192 | 15655922 | 15658483 | 2561 | loss | 1594 | C9orf93 | Exon+ve, ≥2 cases | Yes |
| 9 | 192 | 15655922 | 15658483 | 2561 | loss | 1881 | C9orf93 | Exon+ve, ≥2 cases | Yes |
| 9 | 193 | 17260655 | 17271186 | 10531 | loss | 1743 | CNTLN | Exon+ve, distinct | Yes |
| | | | | | | | | CNVs, same Gene | |
| 9 | 194 | 17348551 | 17356839 | 8288 | loss | 1502 | CNTLN | Exon+ve, distinct | Yes |
| | | | | | | | | CNVs, same Gene | |
| 9 | 195 | 19775974 | 19783547 | 7573 | loss | 1418 | SLC24A2 | Exon+ve, ≥2 cases | Yes |
| 9 | 195 | 19775974 | 19783547 | 7573 | loss | 1511 | SLC24A2 | Exon+ve, ≥2 cases | Yes |
| 9 | 196 | 21267946 | 21274020 | 6074 | loss | 1418 | IFNA22P | Exon+ve, ≥2 cases | Yes |
| 9 | 196 | 21267946 | 21274020 | 6074 | gain | 2020 | IFNA22P | Exon+ve, ≥2 cases | Yes |
| 9 | 197 | 21321182 | 21330461 | 9279 | loss | 1418 | KLHL9 | Exon+ve, ≥2 cases | Yes |
| 9 | 197 | 21321182 | 21330461 | 9279 | loss | 1687 | KLHL9 | Exon+ve, ≥2 cases | Yes |
| 9 | 198 | 21422879 | 21434788 | 11909 | loss | 1418 | IFNA1 | Exon+ve, ≥2 cases | Yes |
| 9 | 198 | 21422879 | 21434788 | 11909 | loss | 1777 | IFNA1 | Exon+ve, ≥2 cases | Yes |
| 9 | 200 | 26919782 | 26925984 | 6202 | loss | 1539 | PLAA | Exon+ve, ≥2 cases | Yes |
| 9 | 200 | 26919782 | 26925984 | 6202 | loss | 1656 | PLAA | Exon+ve, ≥2 cases | Yes |
| 9 | 201 | 32459710 | 32463040 | 3330 | loss | 2003 | DDX58 | Exon+ve, distinct | Yes |
| | | | | | | | | CNVs, same Gene | |
| 9 | 202 | 32490919 | 32498096 | 7177 | loss | 1645 | DDX58 | Exon+ve, distinct | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 9 | 203 | 36263984 | 36268995 | 5011 | gain | 1716 | GNE | CNVs, same Gene | |
| 9 | 203 | 36263984 | 36268995 | 5011 | gain | 1829 | GNE | Exon+ve, ≥2 cases | Yes |
| 9 | 204 | 73777414 | 73780717 | 3303 | gain | 1793 | C9orf85 | Exon+ve, ≥2 cases | Yes |
| 9 | 204 | 73777414 | 73780717 | 3303 | gain | 1883 | C9orf85 | Exon+ve, ≥2 cases | Yes |
| 9 | 204 | 73777414 | 73780717 | 3303 | gain | 1893 | C9orf85 | Exon+ve, ≥2 cases | Yes |
| 9 | 205 | 79049925 | 79067111 | 17186 | gain | 1782 | VPS13A | Exon+ve, ≥2 cases | Yes |
| 9 | 205 | 79049925 | 79067111 | 17186 | gain | 1897 | VPS13A | Exon+ve, ≥2 cases | Yes |
| 9 | 205 | 79049925 | 79067111 | 17186 | gain | 1938 | VPS13A | Exon+ve, ≥2 cases | Yes |
| 9 | 206 | 92596909 | 92617806 | 20897 | gain | 1423 | SYK | Exon+ve, distinct | Yes |
| 9 | 207 | 92658019 | 92700662 | 42643 | gain | 1626 | SYK | CNVs, same Gene Exon+ve, distinct | Yes |
| 9 | 208 | 98831789 | 98831814 | 25 | gain | 1629 | CTSL2 | CNVs, same Gene Exon+ve, ≥2 cases | Yes |
| 9 | 208 | 98831789 | 98831814 | 25 | loss | 1715 | CTSL2 | Exon+ve, ≥2 cases | Yes |
| 9 | 208 | 98831789 | 98831814 | 25 | loss | 1718 | CTSL2 | Exon+ve, ≥2 cases | Yes |
| 9 | 209 | 115858589 | 115903754 | 45165 | gain | 1406 | ZNF618, AMBP, KIF12 | Exon+ve, ≥2 cases | Yes |
| 9 | 209 | 115858589 | 115903754 | 45165 | gain | 2020 | ZNF618, AMBP, KIF12 | Exon+ve, ≥2 cases | Yes |
| 9 | 210 | 116088109 | 116118906 | 30797 | gain | 1406 | COL27A1 | Exon+ve, ≥2 cases | Yes |
| 9 | 210 | 116088109 | 116118906 | 30797 | gain | 2020 | COL27A1 | Exon+ve, ≥2 cases | Yes |
| 9 | 211 | 116142500 | 116144225 | 1725 | loss | 1301 | AKNA | Exon+ve, ≥2 cases | Yes |
| 9 | 211 | 116142500 | 116144225 | 1725 | gain | 2020 | AKNA | Exon+ve, ≥2 cases | Yes |
| 9 | 212 | 118405993 | 118469712 | 63719 | loss | 1622 | ASTN2 | Exon+ve, distinct | Yes |
| 9 | 213 | 118469713 | 118507633 | 37920 | loss | 1559 | ASTN2, TRIM32 | Exon+ve, ≥2 cases | Yes |
| 9 | 213 | 118469713 | 118507633 | 37920 | loss | 1622 | ASTN2, TRIM32 | Exon+ve, ≥2 cases | Yes |
| 9 | 214 | 118524254 | 118532360 | 8106 | loss | 1559 | ASTN2 | Exon+ve, distinct | Yes |
| 9 | 215 | 127014097 | 127028444 | 14347 | loss | 1222 | RABEPK | CNVs, same Gene Exon+ve, ≥2 cases | Yes |
| 9 | 215 | 127014097 | 127028444 | 14347 | loss | 1669 | RABEPK | Exon+ve, ≥2 cases | Yes |
| 9 | 216 | 132910836 | 132912214 | 1378 | loss | 1621 | LAMC3 | Exon+ve, ≥2 cases | Yes |
| 9 | 216 | 132910836 | 132912214 | 1378 | loss | 1639 | LAMC3 | Exon+ve, ≥2 cases | Yes |
| 9 | 216 | 132910836 | 132912214 | 1378 | loss | 1720 | LAMC3 | Exon+ve, ≥2 cases | Yes |
| 9 | 217 | 132912215 | 132916079 | 3864 | loss | 1345 | LAMC3 | Exon+ve, ≥2 cases | Yes |
| 9 | 217 | 132912215 | 132916079 | 3864 | loss | 1621 | LAMC3 | Exon+ve, ≥2 cases | Yes |
| 9 | 217 | 132912215 | 132916079 | 3864 | loss | 1639 | LAMC3 | Exon+ve, ≥2 cases | Yes |
| 9 | 217 | 132912215 | 132916079 | 3864 | loss | 1720 | LAMC3 | Exon+ve, ≥2 cases | Yes |
| 9 | 218 | 132916080 | 132921442 | 5362 | loss | 1345 | LAMC3 | Exon+ve, ≥2 cases | Yes |
| 9 | 218 | 132916080 | 132921442 | 5362 | loss | 1621 | LAMC3 | Exon+ve, ≥2 cases | Yes |
| 9 | 218 | 132916080 | 132921442 | 5362 | loss | 1639 | LAMC3 | Exon+ve, ≥2 cases | Yes |
| 9 | 218 | 132916080 | 132921442 | 5362 | loss | 1720 | LAMC3 | Exon+ve, ≥2 cases | Yes |
| 9 | 218 | 132916080 | 132921442 | 5362 | loss | 1897 | LAMC3 | Exon+ve, ≥2 cases | Yes |
| 9 | 219 | 134924325 | 134928569 | 4244 | loss | 1321 | CEL | Exon+ve, ≥2 cases | Yes |
| 9 | 219 | 134924325 | 134928569 | 4244 | gain | 1887 | CEL | Exon+ve, ≥2 cases | Yes |
| 10 | 220 | 5985730 | 5988631 | 2901 | loss | 1307 | FBXO18 | Exon+ve, ≥2 cases | Yes |
| 10 | 220 | 5985730 | 5988631 | 2901 | loss | 1409 | FBXO18 | Exon+ve, ≥2 cases | Yes |
| 10 | 220 | 5985730 | 5988631 | 2901 | loss | 1619 | FBXO18 | Exon+ve, ≥2 cases | Yes |
| 10 | 220 | 5985730 | 5988631 | 2901 | loss | 1654 | FBXO18 | Exon+ve, ≥2 cases | Yes |
| 10 | 220 | 5985730 | 5988631 | 2901 | loss | 2024 | FBXO18 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 10 | 221 | 5988632 | 5993423 | 4791 | loss | 1307 | FBXO18 | Exon+ve, ≥2 cases | Yes |
| 10 | 221 | 5988632 | 5993423 | 4791 | loss | 1409 | FBXO18 | Exon+ve, ≥2 cases | Yes |
| 10 | 221 | 5988632 | 5993423 | 4791 | loss | 1619 | FBXO18 | Exon+ve, ≥2 cases | Yes |
| 10 | 221 | 5988632 | 5993423 | 4791 | loss | 1654 | FBXO18 | Exon+ve, ≥2 cases | Yes |
| 10 | 222 | 25049572 | 25051425 | 1853 | gain | 1401 | ARHGAP21 | Exon+ve, ≥2 cases | Yes |
| 10 | 222 | 25049572 | 25051425 | 1853 | loss | 1548 | ARHGAP21 | Exon+ve, ≥2 cases | Yes |
| 10 | 222 | 25049572 | 25051425 | 1853 | loss | 1699 | ARHGAP21 | Exon+ve, ≥2 cases | Yes |
| 10 | 222 | 25049572 | 25051425 | 1853 | loss | 1724 | ARHGAP21 | Exon+ve, ≥2 cases | Yes |
| 10 | 222 | 25049572 | 25051425 | 1853 | gain | 1820 | ARHGAP21 | Exon+ve, ≥2 cases | Yes |
| 10 | 222 | 25049572 | 25051425 | 1853 | loss | 1961 | ARHGAP21 | Exon+ve, ≥2 cases | Yes |
| 10 | 223 | 25051426 | 25057232 | 5806 | gain | 1401 | ARHGAP21 | Exon+ve, ≥2 cases | Yes |
| 10 | 223 | 25051426 | 25057232 | 5806 | gain | 1820 | ARHGAP21 | Exon+ve, ≥2 cases | Yes |
| 10 | 224 | 42318589 | 42340738 | 22149 | gain | 1299 | ZNF37BP | Exon+ve, ≥2 cases | Yes |
| 10 | 224 | 42318589 | 42340738 | 22149 | gain | 1746 | ZNF37BP | Exon+ve, ≥2 cases | Yes |
| 10 | 225 | 42955952 | 43009997 | 54045 | gain | 1746 | RASGEF1A, CSGALNACT2 | Exon+ve, ≥2 cases | Yes |
| 10 | 225 | 42955952 | 43009997 | 54045 | gain | 1968 | RASGEF1A, CSGALNACT2 | Exon+ve, ≥2 cases | Yes |
| 10 | 226 | 44921903 | 44960469 | 38566 | gain | 1295 | LOC100133308 | Exon+ve, ≥2 cases | Yes |
| 10 | 226 | 44921903 | 44960469 | 38566 | gain | 1968 | LOC100133308 | Exon+ve, ≥2 cases | Yes |
| 10 | 227 | 45478103 | 45487334 | 9231 | gain | 1408 | ANUBL1 | Exon+ve, ≥2 cases | Yes |
| 10 | 227 | 45478103 | 45487334 | 9231 | gain | 1653 | ANUBL1 | Exon+ve, ≥2 cases | Yes |
| 10 | 228 | 55328218 | 55334606 | 6388 | gain | 1309 | PCDH15 | Exon+ve, ≥2 cases | Yes |
| 10 | 228 | 55328218 | 55334606 | 6388 | gain | 1429 | PCDH15 | Exon+ve, ≥2 cases | Yes |
| 10 | 229 | 55580662 | 55589321 | 8659 | gain | 1429 | PCDH15 | Exon+ve, ≥2 cases | Yes |
| 10 | 229 | 55580662 | 55589321 | 8659 | loss | 1475 | PCDH15 | Exon+ve, ≥2 cases | Yes |
| 10 | 229 | 55580662 | 55589321 | 8659 | loss | 1537 | PCDH15 | Exon+ve, ≥2 cases | Yes |
| 10 | 230 | 67627258 | 67723299 | 96041 | loss | 1835 | CTNNA3 | Exon+ve, distinct CNVs, same Gene | Yes |
| 10 | 231 | 68606250 | 68611060 | 4810 | loss | 1970 | CTNNA3 | Exon+ve, distinct CNVs, same Gene | Yes |
| 10 | 232 | 69018417 | 69100982 | 82565 | gain | 1780 | CTNNA3 | Exon+ve, distinct CNVs, same Gene | Yes |
| 10 | 233 | 116963862 | 116971507 | 7645 | gain | 1292 | ATRNL1 | Exon+ve, ≥2 cases | Yes |
| 10 | 233 | 116963862 | 116971507 | 7645 | gain | 1394 | ATRNL1 | Exon+ve, ≥2 cases | Yes |
| 10 | 233 | 116963862 | 116971507 | 7645 | gain | 1834 | ATRNL1 | Exon+ve, ≥2 cases | Yes |
| 10 | 233 | 116963862 | 116971507 | 7645 | gain | 1880 | ATRNL1 | Exon+ve, ≥2 cases | Yes |
| 10 | 233 | 116963862 | 116971507 | 7645 | gain | 1924 | ATRNL1 | Exon+ve, ≥2 cases | Yes |
| 10 | 234 | 118190679 | 118193786 | 3107 | loss | 1287 | PNLIPRP3 | Exon+ve, ≥2 cases | Yes |
| 10 | 234 | 118190679 | 118193786 | 3107 | gain | 2036 | PNLIPRP3 | Exon+ve, ≥2 cases | Yes |
| 10 | 235 | 131651597 | 131652807 | 1210 | loss | 1572 | EBF3 | Exon+ve, ≥2 cases | Yes |
| 10 | 235 | 131651597 | 131652807 | 1210 | gain | 1597 | EBF3 | Exon+ve, ≥2 cases | Yes |
| 10 | 235 | 131651597 | 131652807 | 1210 | gain | 1644 | EBF3 | Exon+ve, ≥2 cases | Yes |
| 10 | 235 | 131651597 | 131652807 | 1210 | gain | 1691 | EBF3 | Exon+ve, ≥2 cases | Yes |
| 10 | 235 | 131651597 | 131652807 | 1210 | loss | 1703 | EBF3 | Exon+ve, ≥2 cases | Yes |
| 10 | 235 | 131651597 | 131652807 | 1210 | loss | 1704 | EBF3 | Exon+ve, ≥2 cases | Yes |
| 10 | 235 | 131651597 | 131652807 | 1210 | gain | 1709 | EBF3 | Exon+ve, ≥2 cases | Yes |
| 10 | 235 | 131651597 | 131652807 | 1210 | loss | 1724 | EBF3 | Exon+ve, ≥2 cases | Yes |
| 11 | 236 | 5766616 | 5774108 | 7492 | gain | 1394 | OR52N1 | Exon+ve, ≥2 cases | Yes |
| 11 | 236 | 5766616 | 5774108 | 7492 | gain | 1536 | OR52N1 | Exon+ve, ≥2 cases | Yes |
| 11 | 236 | 5766616 | 5774108 | 7492 | gain | 1538 | OR52N1 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 11 | 236 | 5766616 | 5774108 | 7492 | gain | 1551 | OR52N1 | Exon+ve, ≥2 cases | Yes |
| 11 | 236 | 5766616 | 5774108 | 7492 | gain | 1727 | OR52N1 | Exon+ve, ≥2 cases | Yes |
| 11 | 236 | 5766616 | 5774108 | 7492 | gain | 1821 | OR52N1 | Exon+ve, ≥2 cases | Yes |
| 11 | 236 | 5766616 | 5774108 | 7492 | gain | 1823 | OR52N1 | Exon+ve, ≥2 cases | Yes |
| 11 | 236 | 5766616 | 5774108 | 7492 | gain | 1824 | OR52N1 | Exon+ve, ≥2 cases | Yes |
| 11 | 236 | 5766616 | 5774108 | 7492 | gain | 1825 | OR52N1 | Exon+ve, ≥2 cases | Yes |
| 11 | 236 | 5766616 | 5774108 | 7492 | gain | 1902 | OR52N1 | Exon+ve, ≥2 cases | Yes |
| 11 | 237 | 5848930 | 5892024 | 43094 | gain | 1301 | OR52E4 | Exon+ve, ≥2 cases | Yes |
| 11 | 237 | 5848930 | 5892024 | 43094 | gain | 1333 | OR52E4 | Exon+ve, ≥2 cases | Yes |
| 11 | 237 | 5848930 | 5892024 | 43094 | gain | 1593 | OR52E4 | Exon+ve, ≥2 cases | Yes |
| 11 | 237 | 5848930 | 5892024 | 43094 | gain | 1920 | OR52E4 | Exon+ve, ≥2 cases | Yes |
| 11 | 238 | 22198120 | 22199909 | 1789 | gain | 1609 | ANO5 | Exon+ve, ≥2 cases | Yes |
| 11 | 238 | 22198120 | 22199909 | 1789 | loss | 2001 | ANO5 | Exon+ve, ≥2 cases | Yes |
| 11 | 239 | 43920001 | 43921971 | 1970 | gain | 1324 | C11orf96 | Exon+ve, ≥2 cases | Yes |
| 11 | 239 | 43920001 | 43921971 | 1970 | loss | 1396 | C11orf96 | Exon+ve, ≥2 cases | Yes |
| 11 | 239 | 43920001 | 43921971 | 1970 | loss | 1530 | C11orf96 | Exon+ve, ≥2 cases | Yes |
| 11 | 239 | 43920001 | 43921971 | 1970 | loss | 1829 | C11orf96 | Exon+ve, ≥2 cases | Yes |
| 11 | 239 | 43920001 | 43921971 | 1970 | gain | 1860 | C11orf96 | Exon+ve, ≥2 cases | Yes |
| 11 | 239 | 43920001 | 43921971 | 1970 | loss | 1874 | C11orf96 | Exon+ve, ≥2 cases | Yes |
| 11 | 239 | 43920001 | 43921971 | 1970 | gain | 1996 | C11orf96 | Exon+ve, ≥2 cases | Yes |
| 11 | 240 | 47142460 | 47155662 | 13202 | loss | 1798 | C11orf49, ARFGAP2, PACSIN3 | Exon+ve, ≥2 cases | Yes |
| 11 | 240 | 47142460 | 47155662 | 13202 | loss | 1852 | C11orf49, ARFGAP2, PACSIN3 | Exon+ve, ≥2 cases | Yes |
| 11 | 240 | 47142460 | 47155662 | 13202 | loss | 1854 | C11orf49, ARFGAP2, PACSIN3 | Exon+ve, ≥2 cases | Yes |
| 11 | 240 | 47142460 | 47155662 | 13202 | loss | 1855 | C11orf49, ARFGAP2, PACSIN3 | Exon+ve, ≥2 cases | Yes |
| 11 | 240 | 47142460 | 47155662 | 13202 | loss | 1857 | C11orf49, ARFGAP2, PACSIN3 | Exon+ve, ≥2 cases | Yes |
| 11 | 240 | 47142460 | 47155662 | 13202 | loss | 1936 | C11orf49, ARFGAP2, PACSIN3 | Exon+ve, ≥2 cases | Yes |
| 11 | 240 | 47142460 | 47155662 | 13202 | loss | 2031 | C11orf49, ARFGAP2, PACSIN3 | Exon+ve, ≥2 cases | Yes |
| 11 | 241 | 51241170 | 51286363 | 45193 | gain | 1708 | OR4A5 | Exon+ve, ≥2 cases | Yes |
| 11 | 241 | 51241170 | 51286363 | 45193 | gain | 1943 | OR4A5 | Exon+ve, ≥2 cases | Yes |
| 11 | 242 | 63065110 | 63070503 | 5393 | loss | 1776 | RARRES3 | Exon+ve, ≥2 cases | Yes |
| 11 | 242 | 63065110 | 63070503 | 5393 | loss | 1950 | RARRES3 | Exon+ve, ≥2 cases | Yes |
| 11 | 243 | 65851949 | 65860867 | 8918 | loss | 1958 | RIN1 | Exon+ve, ≥2 cases | Yes |
| 11 | 243 | 65851949 | 65860867 | 8918 | loss | 1993 | RIN1 | Exon+ve, ≥2 cases | Yes |
| 11 | 244 | 70167828 | 70206326 | 38498 | loss | 1835 | SHANK2 | Special | Yes |
| 11 | 245 | 95194789 | 95195561 | 772 | loss | 1349 | CEP57 | Exon+ve, ≥2 cases | Yes |
| 11 | 245 | 95194789 | 95195561 | 772 | loss | 1946 | CEP57 | Exon+ve, ≥2 cases | Yes |
| 11 | 246 | 99646264 | 99660303 | 14039 | loss | 1936 | CNTN5 | Special | Yes |
| 11 | 247 | 110872005 | 110875598 | 3593 | loss | 1276 | BTG4 | Exon+ve, ≥2 cases | Yes |
| 11 | 247 | 110872005 | 110875598 | 3593 | loss | 1465 | BTG4 | Exon+ve, ≥2 cases | Yes |
| 11 | 248 | 125808845 | 125810734 | 1889 | gain | 1713 | KIRREL3 | Exon+ve, ≥2 cases | Yes |
| 11 | 248 | 125808845 | 125810734 | 1889 | gain | 1861 | KIRREL3 | Exon+ve, ≥2 cases | Yes |
| 11 | 249 | 127895094 | 127897121 | 2027 | gain | 1429 | ETS1 | Exon+ve, ≥2 cases | Yes |
| 11 | 249 | 127895094 | 127897121 | 2027 | gain | 1779 | ETS1 | Exon+ve, ≥2 cases | Yes |
| 12 | 250 | 8173177 | 8179355 | 6178 | gain | 1246 | POU5F1P3, CLEC4A | Exon+ve, ≥2 cases | Yes |
| 12 | 250 | 8173177 | 8179355 | 6178 | gain | 1308 | POU5F1P3, CLEC4A | Exon+ve, ≥2 cases | Yes |
| 12 | 251 | 9777077 | 9778598 | 1521 | loss | 1264 | CLECL1 | Exon+ve, ≥2 cases | Yes |
| 12 | 251 | 9777077 | 9778598 | 1521 | loss | 1705 | CLECL1 | Exon+ve, ≥2 cases | Yes |
| 12 | 252 | 20859893 | 20860186 | 293 | loss | 1225 | SLCO1B3 | Exon+ve, ≥2 cases | Yes |
| 12 | 252 | 20859893 | 20860186 | 293 | loss | 1488 | SLCO1B3 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 12 | 252 | 20859893 | 20860186 | 293 | loss | 1577 | SLCO1B3 | Exon+ve, ≥2 cases | Yes |
| 12 | 252 | 20859893 | 20860186 | 293 | loss | 1581 | SLCO1B3 | Exon+ve, ≥2 cases | Yes |
| 12 | 253 | 21514182 | 21516409 | 2227 | gain | 1465 | RECQL, PYROXD1 | Exon+ve, ≥2 cases | Yes |
| 12 | 253 | 21514182 | 21516409 | 2227 | gain | 1925 | RECQL, PYROXD1 | Exon+ve, ≥2 cases | Yes |
| 12 | 254 | 50517950 | 50577179 | 59229 | gain | 1768 | ANKRD33 | Exon+ve, ≥2 cases | Yes |
| 12 | 254 | 50517950 | 50577179 | 59229 | gain | 1836 | ANKRD33 | Exon+ve, ≥2 cases | Yes |
| 12 | 255 | 51132302 | 51150231 | 17929 | loss | 1844 | KRT6C | Exon+ve, ≥2 cases | Yes |
| 12 | 255 | 51132302 | 51150231 | 17929 | loss | 2037 | KRT6C | Exon+ve, ≥2 cases | Yes |
| 12 | 256 | 95110503 | 95112470 | 1967 | loss | 1447 | ELK3 | Exon+ve, ≥2 cases | Yes |
| 12 | 256 | 95110503 | 95112470 | 1967 | loss | 1728 | ELK3 | Exon+ve, ≥2 cases | Yes |
| 12 | 256 | 95110503 | 95112470 | 1967 | loss | 1742 | ELK3 | Exon+ve, ≥2 cases | Yes |
| 12 | 256 | 95110503 | 95112470 | 1967 | loss | 1957 | ELK3 | Exon+ve, ≥2 cases | Yes |
| 12 | 256 | 95110503 | 95112470 | 1967 | loss | 1961 | ELK3 | Exon+ve, ≥2 cases | Yes |
| 12 | 256 | 95110503 | 95112470 | 1967 | loss | 1965 | ELK3 | Exon+ve, ≥2 cases | Yes |
| 12 | 256 | 95110503 | 95112470 | 1967 | loss | 1967 | ELK3 | Exon+ve, ≥2 cases | Yes |
| 12 | 257 | 97699965 | 97704854 | 4889 | loss | 1872 | ANKS1B | Exon+ve, ≥2 cases | Yes |
| 12 | 257 | 97699965 | 97704854 | 4889 | loss | 1884 | ANKS1B | Exon+ve, ≥2 cases | Yes |
| 12 | 258 | 108878848 | 108882203 | 3355 | loss | 1279 | GIT2 | Exon+ve, ≥2 cases | Yes |
| 12 | 258 | 108878848 | 108882203 | 3355 | loss | 1665 | GIT2 | Exon+ve, ≥2 cases | Yes |
| 12 | 259 | 110666479 | 110799506 | 133027 | gain | 1763 | ACAD10, MAPKAPK5, C12orf47, ALDH2 | Exon+ve, ≥2 cases | Yes |
| 12 | 259 | 110666479 | 110799506 | 133027 | gain | 2022 | ACAD10, MAPKAPK5, C12orf47, ALDH2 | Exon+ve, ≥2 cases | Yes |
| 12 | 260 | 130944468 | 130946248 | 1780 | loss | 1416 | ULK1 | Exon+ve, ≥2 cases | Yes |
| 12 | 260 | 130944468 | 130946248 | 1780 | loss | 1448 | ULK1 | Exon+ve, ≥2 cases | Yes |
| 12 | 260 | 130944468 | 130946248 | 1780 | loss | 1471 | ULK1 | Exon+ve, ≥2 cases | Yes |
| 12 | 260 | 130944468 | 130946248 | 1780 | loss | 1474 | ULK1 | Exon+ve, ≥2 cases | Yes |
| 12 | 260 | 130944468 | 130946248 | 1780 | loss | 1492 | ULK1 | Exon+ve, ≥2 cases | Yes |
| 12 | 260 | 130944468 | 130946248 | 1780 | loss | 1493 | ULK1 | Exon+ve, ≥2 cases | Yes |
| 12 | 260 | 130944468 | 130946248 | 1780 | loss | 1496 | ULK1 | Exon+ve, ≥2 cases | Yes |
| 12 | 260 | 130944468 | 130946248 | 1780 | loss | 1497 | ULK1 | Exon+ve, ≥2 cases | Yes |
| 12 | 260 | 130944468 | 130946248 | 1780 | loss | 1498 | ULK1 | Exon+ve, ≥2 cases | Yes |
| 12 | 260 | 130944468 | 130946248 | 1780 | loss | 1500 | ULK1 | Exon+ve, ≥2 cases | Yes |
| 12 | 260 | 130944468 | 130946248 | 1780 | loss | 1505 | ULK1 | Exon+ve, ≥2 cases | Yes |
| 12 | 260 | 130944468 | 130946248 | 1780 | loss | 1517 | ULK1 | Exon+ve, ≥2 cases | Yes |
| 12 | 260 | 130944468 | 130946248 | 1780 | loss | 1566 | ULK1 | Exon+ve, ≥2 cases | Yes |
| 12 | 260 | 130944468 | 130946248 | 1780 | loss | 1579 | ULK1 | Exon+ve, ≥2 cases | Yes |
| 12 | 260 | 130944468 | 130946248 | 1780 | loss | 1580 | ULK1 | Exon+ve, ≥2 cases | Yes |
| 12 | 260 | 130944468 | 130946248 | 1780 | loss | 1582 | ULK1 | Exon+ve, ≥2 cases | Yes |
| 12 | 261 | 22323381 | 22381531 | 58150 | gain | 1662 | BASP1P1 | Exon+ve, ≥2 cases | Yes |
| 12 | 261 | 22323381 | 22381531 | 58150 | loss | 1714 | BASP1P1 | Exon+ve, ≥2 cases | Yes |
| 12 | 261 | 22323381 | 22381531 | 58150 | gain | 1744 | BASP1P1 | Exon+ve, ≥2 cases | Yes |
| 12 | 261 | 22323381 | 22381531 | 58150 | loss | 1919 | BASP1P1 | Exon+ve, ≥2 cases | Yes |
| 13 | 262 | 35695761 | 35699663 | 3902 | gain | 1564 | C13orf38-SOHLH2, C13orf38 | Exon+ve, ≥2 cases | Yes |
| 13 | 262 | 35695761 | 35699663 | 3902 | gain | 1803 | C13orf38-SOHLH2, C13orf38 | Exon+ve, ≥2 cases | Yes |
| 13 | 263 | 42366568 | 42368413 | 1845 | loss | 1536 | EPSTI1 | Exon+ve, distinct CNVs, same Gene | Yes |
| 13 | 263 | 42369769 | 42372717 | 2948 | gain | 1502 | EPSTI1 | Exon+ve, distinct CNVs, same Gene | Yes |
| 13 | 264 | 42372718 | 42420937 | 48219 | gain | 1502 | EPSTI1 | Exon+ve, ≥2 cases | Yes |
| 13 | 264 | 42372718 | 42420937 | 48219 | gain | 1897 | EPSTI1 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 13 | 264 | 42423318 | 42441665 | 18347 | gain | 1897 | EPSTI1 | Exon+ve, distinct CNVs, same Gene | Yes |
| 14 | 265 | 22811680 | 22814547 | 2867 | gain | 1642 | HOMEZ | Exon+ve, ≥2 cases | Yes |
| 14 | 265 | 22811680 | 22814547 | 2867 | gain | 1875 | HOMEZ | Exon+ve, ≥2 cases | Yes |
| 14 | 266 | 22929952 | 22958797 | 28845 | Loss | 1537 | MYH6 | Ctrl pos High OR | Yes |
| 14 | 266 | 22929952 | 22959469 | 29517 | Loss | 1669 | MYH6 | Ctrl pos High OR | Yes |
| 14 | 266 | 22943262 | 22951086 | 7824 | Loss | 1577 | MYH6 | Ctrl pos High OR | Yes |
| 14 | 266 | 22943262 | 22955470 | 12208 | Loss | 1856 | MYH6 | Ctrl pos High OR | Yes |
| 14 | 267 | 22946615 | 22947639 | 1024 | Loss | 1718 | MYH6 | Ctrl pos High OR | Yes |
| 14 | 267 | 22946615 | 22947639 | 1024 | Loss | 1802 | MYH6 | Ctrl pos High OR | Yes |
| 14 | 267 | 22946615 | 22947639 | 1024 | Loss | 1816 | MYH6 | Ctrl pos High OR | Yes |
| 14 | 267 | 22946615 | 22947639 | 1024 | Loss | 1817 | MYH6 | Ctrl pos High OR | Yes |
| 14 | 267 | 22946615 | 22947034 | 419 | Loss | 1819 | MYH6 | Ctrl pos High OR | Yes |
| 14 | 267 | 22946615 | 22947639 | 1024 | Loss | 1820 | MYH6 | Ctrl pos High OR | Yes |
| 14 | 267 | 22946615 | 22947639 | 1024 | Loss | 1850 | MYH6 | Ctrl pos High OR | Yes |
| 14 | 267 | 22946615 | 22947639 | 1024 | Loss | 1895 | MYH6 | Ctrl pos High OR | Yes |
| 14 | 267 | 22946615 | 22947639 | 1024 | Loss | 1993 | MYH6 | Ctrl pos High OR | Yes |
| 14 | 267 | 22946615 | 22955470 | 8855 | Loss | 2032 | MYH6 | Ctrl pos High OR | Yes |
| 14 | 267 | 22946615 | 22947639 | 1024 | Loss | 2043 | MYH6 | Ctrl pos High OR | Yes |
| 14 | 268 | 30647372 | 30649432 | 2060 | loss | 1775 | HECTD1 | Exon+ve, distinct CNVs, same Gene | Yes |
| 14 | 269 | 30649432 | 30655206 | 5774 | loss | 1403 | HECTD1 | Exon+ve, distinct CNVs, same Gene | Yes |
| 14 | 270 | 47289928 | 47300593 | 10665 | loss | 1570 | MIR548Y | Exon+ve, ≥2 cases | Yes |
| 14 | 270 | 47289928 | 47300593 | 10665 | gain | 1709 | MIR548Y | Exon+ve, ≥2 cases | Yes |
| 14 | 271 | 51528998 | 51531503 | 2505 | loss | 1226 | C14orf166 | Exon+ve, ≥2 cases | Yes |
| 14 | 271 | 51528998 | 51531503 | 2505 | loss | 1253 | C14orf166 | Exon+ve, ≥2 cases | Yes |
| 14 | 271 | 51528998 | 51531503 | 2505 | loss | 1650 | C14orf166 | Exon+ve, ≥2 cases | Yes |
| 14 | 272 | 60551981 | 60553070 | 1089 | loss | 1269 | SLC38A6 | Exon+ve, ≥2 cases | Yes |
| 14 | 272 | 60551981 | 60553070 | 1089 | gain | 1281 | SLC38A6 | Exon+ve, ≥2 cases | Yes |
| 14 | 272 | 60551981 | 60553070 | 1089 | loss | 1470 | SLC38A6 | Exon+ve, ≥2 cases | Yes |
| 14 | 272 | 60551981 | 60553070 | 1089 | gain | 1773 | SLC38A6 | Exon+ve, ≥2 cases | Yes |
| 14 | 272 | 60551981 | 60553070 | 1089 | loss | 2000 | SLC38A6 | Exon+ve, ≥2 cases | Yes |
| 14 | 273 | 69012378 | 69022484 | 10106 | loss | 1852 | UPF0639 | Exon+ve, ≥2 cases | Yes |
| 14 | 273 | 69012378 | 69022484 | 10106 | loss | 1871 | UPF0639 | Exon+ve, ≥2 cases | Yes |
| 14 | 274 | 70274601 | 70276007 | 1406 | loss | 1314 | MAP3K9 | Exon+ve, ≥2 cases | Yes |
| 14 | 274 | 70274601 | 70276007 | 1406 | loss | 1910 | MAP3K9 | Exon+ve, ≥2 cases | Yes |
| 14 | 274 | 70274601 | 70276007 | 1406 | loss | 2001 | MAP3K9 | Exon+ve, ≥2 cases | Yes |
| 14 | 274 | 70274601 | 70276007 | 1406 | loss | 2002 | MAP3K9 | Exon+ve, ≥2 cases | Yes |
| 14 | 275 | 73010755 | 73015309 | 4554 | gain | 1291 | HEATR4 | Exon+ve, ≥2 cases | Yes |
| 14 | 275 | 73010755 | 73015309 | 4554 | loss | 1806 | HEATR4 | Exon+ve, ≥2 cases | Yes |
| 14 | 276 | 73051686 | 73058102 | 6416 | loss | 1237 | HEATR4 | Exon+ve, ≥2 cases | Yes |
| 14 | 276 | 73051686 | 73058102 | 6416 | gain | 1291 | HEATR4 | Exon+ve, ≥2 cases | Yes |
| 14 | 277 | 73058103 | 73060300 | 2197 | loss | 1237 | HEATR4 | Exon+ve, ≥2 cases | Yes |
| 14 | 277 | 73058103 | 73060300 | 2197 | gain | 1291 | HEATR4 | Exon+ve, ≥2 cases | Yes |
| 14 | 277 | 73058103 | 73060300 | 2197 | loss | 1676 | HEATR4 | Exon+ve, ≥2 cases | Yes |
| 14 | 277 | 73058103 | 73060300 | 2197 | loss | 1687 | HEATR4 | Exon+ve, ≥2 cases | Yes |
| 14 | 277 | 73058103 | 73060300 | 2197 | loss | 1718 | HEATR4 | Exon+ve, ≥2 cases | Yes |
| 14 | 277 | 73058103 | 73060300 | 2197 | loss | 1721 | HEATR4 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 14 | 278 | 77935509 | 77995126 | 59617 | loss | 1908 | NRXN3 | Exon+ve, distinct | Yes |
| 14 | 279 | 79195482 | 79220608 | 25126 | loss | 2036 | NRXN3 | Exon+ve, distinct CNVs, same Gene | Yes |
| 14 | 280 | 99827183 | 99828301 | 1118 | gain | 1790 | SLC25A29 | Exon+ve, distinct | Yes |
| 14 | 280 | 99828301 | 99829704 | 1403 | loss | 1705 | SLC25A29 | Exon+ve, distinct CNVs, same Gene | Yes |
| 14 | 281 | 102401445 | 102409996 | 8551 | gain | 1447 | TRAF3 | Exon+ve, ≥2 cases | Yes |
| 14 | 281 | 102401445 | 102409996 | 8551 | gain | 1838 | TRAF3 | Exon+ve, ≥2 cases | Yes |
| 14 | 282 | 102447174 | 102447535 | 361 | gain | 1447 | TRAF3 | Exon+ve, ≥2 cases | Yes |
| 14 | 282 | 102447174 | 102447535 | 361 | gain | 1820 | TRAF3 | Exon+ve, ≥2 cases | Yes |
| 14 | 283 | 102447536 | 102450225 | 2689 | gain | 1447 | TRAF3 | Exon+ve, ≥2 cases | Yes |
| 14 | 283 | 102447536 | 102450225 | 2689 | loss | 1800 | TRAF3 | Exon+ve, ≥2 cases | Yes |
| 14 | 283 | 102447536 | 102450225 | 2689 | loss | 1820 | TRAF3 | Exon+ve, ≥2 cases | Yes |
| 15 | 284 | 26805834 | 27028093 | 222259 | gain | 1988 | LOC646278, LOC100289656, APBA2 | Exon+ve, ≥2 cases | Yes |
| 15 | 284 | 26805834 | 27028093 | 222259 | loss | 1994 | LOC646278, LOC100289656, APBA2 | Exon+ve, ≥2 cases | Yes |
| 15 | 285 | 27253448 | 27314654 | 61206 | gain | 1988 | FAM189A1 | Exon+ve, ≥2 cases | Yes |
| 15 | 285 | 27253448 | 27314654 | 61206 | loss | 1994 | FAM189A1 | Exon+ve, ≥2 cases | Yes |
| 15 | 286 | 27321201 | 27469286 | 148085 | gain | 1988 | FAM189A1, NDNL2 | Exon+ve, ≥2 cases | Yes |
| 15 | 286 | 27321201 | 27469286 | 148085 | loss | 1994 | FAM189A1, NDNL2 | Exon+ve, ≥2 cases | Yes |
| 15 | 287 | 27584561 | 27687173 | 102612 | gain | 1988 | UBR1 | Exon+ve, ≥2 cases | Yes |
| 15 | 287 | 27584561 | 27687173 | 102612 | loss | 1994 | UBR1 | Exon+ve, ≥2 cases | Yes |
| 15 | 288 | 41098343 | 41101310 | 2967 | loss | 1630 | UBR1 | Exon+ve, ≥2 cases | Yes |
| 15 | 288 | 41098343 | 41101310 | 2967 | loss | 2018 | CASC4 | Exon+ve, ≥2 cases | Yes |
| 15 | 289 | 42365660 | 42371493 | 5833 | loss | 1638 | CASC4 | Exon+ve, ≥2 cases | Yes |
| 15 | 289 | 42365660 | 42371493 | 5833 | loss | 1659 | CASC4 | Exon+ve, ≥2 cases | Yes |
| 15 | 289 | 42365660 | 42371493 | 5833 | loss | 1660 | CASC4 | Exon+ve, ≥2 cases | Yes |
| 15 | 289 | 42365660 | 42371493 | 5833 | loss | 1662 | CASC4 | Exon+ve, ≥2 cases | Yes |
| 15 | 290 | 54513726 | 54522863 | 9137 | loss | 1237 | TEX9, MNS1 | Exon+ve, ≥2 cases | Yes |
| 15 | 290 | 54513726 | 54522863 | 9137 | loss | 1347 | TEX9, MNS1 | Exon+ve, ≥2 cases | Yes |
| 15 | 290 | 54513726 | 54522863 | 9137 | loss | 1441 | TEX9, MNS1 | Exon+ve, ≥2 cases | Yes |
| 15 | 290 | 54513726 | 54522863 | 9137 | loss | 1456 | TEX9, MNS1 | Exon+ve, ≥2 cases | Yes |
| 15 | 290 | 54513726 | 54522863 | 9137 | loss | 1494 | TEX9, MNS1 | Exon+ve, ≥2 cases | Yes |
| 15 | 290 | 54513726 | 54522863 | 9137 | loss | 1496 | TEX9, MNS1 | Exon+ve, ≥2 cases | Yes |
| 15 | 290 | 54513726 | 54522863 | 9137 | loss | 1497 | TEX9, MNS1 | Exon+ve, ≥2 cases | Yes |
| 15 | 290 | 54513726 | 54522863 | 9137 | loss | 1997 | TEX9, MNS1 | Exon+ve, ≥2 cases | Yes |
| 15 | 291 | 56031543 | 56036056 | 4513 | loss | 1680 | ALDH1A2 | Exon+ve, distinct CNVs, same Gene | Yes |
| 15 | 292 | 56039531 | 56044966 | 5435 | loss | 1680 | ALDH1A2 | Exon+ve, distinct CNVs, same Gene | Yes |
| 15 | 293 | 71247339 | 71258333 | 10994 | gain | 1293 | NEO1 | Exon+ve, ≥2 cases | Yes |
| 15 | 293 | 71247339 | 71258333 | 10994 | loss | 1415 | NEO1 | Exon+ve, ≥2 cases | Yes |
| 15 | 294 | 72804753 | 72806259 | 1506 | gain | 1309 | CYP1A1 | Exon+ve, ≥2 cases | Yes |
| 15 | 294 | 72804753 | 72806259 | 1506 | loss | 1415 | CYP1A1 | Exon+ve, ≥2 cases | Yes |
| 15 | 295 | 73443782 | 73460290 | 16508 | gain | 1301 | MAN2C1, SIN3A | Exon+ve, ≥2 cases | Yes |
| 15 | 295 | 73443782 | 73460290 | 16508 | loss | 1415 | MAN2C1, SIN3A | Exon+ve, ≥2 cases | Yes |
| 15 | 296 | 73661881 | 73680497 | 18616 | loss | 1415 | SNUPN | Exon+ve, ≥2 cases | Yes |
| 15 | 296 | 73661881 | 73680497 | 18616 | gain | 2018 | SNUPN | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 15 | 297 | 73680498 | 73684636 | 4138 | loss | 1415 | SNUPN | Exon+ve, ≥2 cases | Yes |
| 15 | 297 | 73680498 | 73684636 | 4138 | loss | 1773 | SNUPN | Exon+ve, ≥2 cases | Yes |
| 15 | 297 | 73680498 | 73684636 | 4138 | gain | 2018 | SNUPN | Exon+ve, ≥2 cases | Yes |
| 15 | 298 | 73690131 | 73729295 | 39164 | loss | 1415 | IMP3, SNX33, SNUPN | Exon+ve, ≥2 cases | Yes |
| 15 | 298 | 73690131 | 73729295 | 39164 | gain | 2018 | IMP3, SNX33, SNUPN | Exon+ve, ≥2 cases | Yes |
| 15 | 299 | 80318994 | 80323704 | 4710 | gain | 1354 | EFTUD1 | Exon+ve, ≥2 cases | Yes |
| 15 | 299 | 80318994 | 80323704 | 4710 | gain | 1740 | EFTUD1 | Exon+ve, ≥2 cases | Yes |
| 15 | 300 | 80329016 | 80364988 | 35972 | gain | 1354 | EFTUD1, FAM154B | Exon+ve, ≥2 cases | Yes |
| 15 | 300 | 80329016 | 80364988 | 35972 | gain | 1740 | EFTUD1, FAM154B | Exon+ve, ≥2 cases | Yes |
| 15 | 301 | 87996761 | 87999025 | 2264 | loss | 1317 | KIF7 | Exon+ve, ≥2 cases | Yes |
| 15 | 301 | 87996761 | 87999025 | 2264 | gain | 1548 | KIF7 | Exon+ve, ≥2 cases | Yes |
| 15 | 302 | 87999026 | 88001168 | 2142 | loss | 1317 | KIF7 | Exon+ve, ≥2 cases | Yes |
| 15 | 302 | 87999026 | 88001168 | 2142 | gain | 1548 | KIF7 | Exon+ve, ≥2 cases | Yes |
| 15 | 302 | 87999026 | 88001168 | 2142 | loss | 1738 | KIF7 | Exon+ve, ≥2 cases | Yes |
| 15 | 303 | 93669003 | 93671527 | 2524 | gain | 1309 | LOC400456 | Exon+ve, ≥2 cases | Yes |
| 15 | 303 | 93669003 | 93671527 | 2524 | loss | 1825 | LOC400456 | Exon+ve, ≥2 cases | Yes |
| 15 | 303 | 93669003 | 93671527 | 2524 | gain | 1837 | LOC400456 | Exon+ve, ≥2 cases | Yes |
| 15 | 303 | 93669003 | 93671527 | 2524 | gain | 1841 | LOC400456 | Exon+ve, ≥2 cases | Yes |
| 15 | 304 | 99236636 | 99239178 | 2542 | loss | 1544 | ALDH1A3 | Exon+ve, ≥2 cases | Yes |
| 15 | 304 | 99236636 | 99239178 | 2542 | loss | 1626 | ALDH1A3 | Exon+ve, ≥2 cases | Yes |
| 15 | 304 | 99236636 | 99239178 | 2542 | gain | 1644 | ALDH1A3 | Exon+ve, ≥2 cases | Yes |
| 15 | 305 | 99632987 | 99634433 | 1446 | gain | 1404 | SELS | Exon+ve, ≥2 cases | Yes |
| 15 | 305 | 99632987 | 99634433 | 1446 | gain | 1728 | SELS | Exon+ve, ≥2 cases | Yes |
| 15 | 306 | 99634434 | 99635701 | 1267 | loss | 1389 | SELS | Exon+ve, ≥2 cases | Yes |
| 15 | 306 | 99634434 | 99635701 | 1267 | gain | 1401 | SELS | Exon+ve, ≥2 cases | Yes |
| 15 | 306 | 99634434 | 99635701 | 1267 | gain | 1404 | SELS | Exon+ve, ≥2 cases | Yes |
| 15 | 306 | 99634434 | 99635701 | 1267 | loss | 1413 | SELS | Exon+ve, ≥2 cases | Yes |
| 15 | 306 | 99634434 | 99635701 | 1267 | gain | 1416 | SELS | Exon+ve, ≥2 cases | Yes |
| 15 | 306 | 99634434 | 99635701 | 1267 | loss | 1434 | SELS | Exon+ve, ≥2 cases | Yes |
| 15 | 306 | 99634434 | 99635701 | 1267 | loss | 1446 | SELS | Exon+ve, ≥2 cases | Yes |
| 15 | 306 | 99634434 | 99635701 | 1267 | loss | 1449 | SELS | Exon+ve, ≥2 cases | Yes |
| 15 | 306 | 99634434 | 99635701 | 1267 | gain | 1461 | SELS | Exon+ve, ≥2 cases | Yes |
| 15 | 306 | 99634434 | 99635701 | 1267 | loss | 1477 | SELS | Exon+ve, ≥2 cases | Yes |
| 15 | 306 | 99634434 | 99635701 | 1267 | gain | 1505 | SELS | Exon+ve, ≥2 cases | Yes |
| 15 | 306 | 99634434 | 99635701 | 1267 | loss | 1529 | SELS | Exon+ve, ≥2 cases | Yes |
| 15 | 306 | 99634434 | 99635701 | 1267 | loss | 1548 | SELS | Exon+ve, ≥2 cases | Yes |
| 15 | 306 | 99634434 | 99635701 | 1267 | gain | 1559 | SELS | Exon+ve, ≥2 cases | Yes |
| 15 | 306 | 99634434 | 99635701 | 1267 | loss | 1572 | SELS | Exon+ve, ≥2 cases | Yes |
| 15 | 306 | 99634434 | 99635701 | 1267 | loss | 1576 | SELS | Exon+ve, ≥2 cases | Yes |
| 15 | 306 | 99634434 | 99635701 | 1267 | loss | 1584 | SELS | Exon+ve, ≥2 cases | Yes |
| 15 | 306 | 99634434 | 99635701 | 1267 | gain | 1596 | SELS | Exon+ve, ≥2 cases | Yes |
| 15 | 306 | 99634434 | 99635701 | 1267 | loss | 1609 | SELS | Exon+ve, ≥2 cases | Yes |
| 15 | 306 | 99634434 | 99635701 | 1267 | gain | 1633 | SELS | Exon+ve, ≥2 cases | Yes |
| 15 | 306 | 99634434 | 99635701 | 1267 | loss | 1672 | SELS | Exon+ve, ≥2 cases | Yes |
| 15 | 306 | 99634434 | 99635701 | 1267 | loss | 1687 | SELS | Exon+ve, ≥2 cases | Yes |
| 15 | 306 | 99634434 | 99635701 | 1267 | loss | 1728 | SELS | Exon+ve, ≥2 cases | Yes |
| 15 | 306 | 99634434 | 99635701 | 1267 | loss | 1829 | SELS | Exon+ve, ≥2 cases | Yes |
| 15 | 306 | 99634434 | 99635701 | 1267 | gain | 1842 | SELS | Exon+ve, ≥2 cases | Yes |
| 15 | 306 | 99634434 | 99635701 | 1267 | loss | 1913 | SELS | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 15 | 306 | 99634434 | 99635701 | 1267 | loss | 1964 | SELS | Exon+ve, ≥2 cases | Yes |
| 16 | 307 | 3047597 | 3065144 | 17547 | loss | 1585 | MMP25, IL32 | Exon+ve, ≥2 cases | Yes |
| 16 | 307 | 3047597 | 3065144 | 17547 | loss | 1804 | MMP25, IL32 | Exon+ve, ≥2 cases | Yes |
| 16 | 307 | 3047597 | 3065144 | 17547 | loss | 1919 | MMP25, IL32 | Exon+ve, ≥2 cases | Yes |
| 16 | 308 | 3868512 | 3870704 | 2192 | loss | 1533 | CREBBP | Exon+ve, ≥2 cases | Yes |
| 16 | 308 | 3868512 | 3870704 | 2192 | loss | 1539 | CREBBP | Exon+ve, ≥2 cases | Yes |
| 16 | 308 | 3868512 | 3870704 | 2192 | gain | 1567 | CREBBP | Exon+ve, ≥2 cases | Yes |
| 16 | 308 | 3868512 | 3870704 | 2192 | loss | 1590 | CREBBP | Exon+ve, ≥2 cases | Yes |
| 16 | 309 | 4187745 | 4192872 | 5127 | loss | 1442 | SRL | Exon+ve, ≥2 cases | Yes |
| 16 | 309 | 4187745 | 4192872 | 5127 | gain | 1567 | SRL | Exon+ve, ≥2 cases | Yes |
| 16 | 310 | 4554395 | 4568979 | 14584 | gain | 1567 | LOC342346 | Exon+ve, ≥2 cases | Yes |
| 16 | 310 | 4554395 | 4568979 | 14584 | loss | 1689 | LOC342346 | Exon+ve, ≥2 cases | Yes |
| 16 | 311 | 4574012 | 4588011 | 13999 | gain | 1567 | LOC342346 | Exon+ve, ≥2 cases | Yes |
| 16 | 311 | 4574012 | 4588011 | 13999 | loss | 1689 | LOC342346 | Exon+ve, ≥2 cases | Yes |
| 16 | 312 | 5047987 | 5049746 | 1759 | loss | 1419 | C16orf89 | Exon+ve, ≥2 cases | Yes |
| 16 | 312 | 5047987 | 5049746 | 1759 | gain | 1567 | C16orf89 | Exon+ve, ≥2 cases | Yes |
| 16 | 313 | 20861337 | 20867356 | 6019 | loss | 1230 | DNAH3 | Exon+ve, ≥2 cases | Yes |
| 16 | 313 | 20861337 | 20867356 | 6019 | loss | 1760 | DNAH3 | Exon+ve, ≥2 cases | Yes |
| 16 | 314 | 22071418 | 22084314 | 12896 | gain | 1426 | VWA3A | Exon+ve, ≥2 cases | Yes |
| 16 | 314 | 22071418 | 22084314 | 12896 | gain | 1946 | VWA3A | Exon+ve, ≥2 cases | Yes |
| 16 | 314 | 22071418 | 22084314 | 12896 | gain | 1962 | VWA3A | Exon+ve, ≥2 cases | Yes |
| 16 | 315 | 28073908 | 28075568 | 1660 | loss | 1295 | XPO6 | Exon+ve, ≥2 cases | Yes |
| 16 | 315 | 28073908 | 28075568 | 1660 | loss | 1917 | XPO6 | Exon+ve, ≥2 cases | Yes |
| 16 | 316 | 31384536 | 31396729 | 12193 | gain | 1232 | TGFB1I1, ARMC5 | Exon+ve, ≥2 cases | Yes |
| 16 | 316 | 31384536 | 31396729 | 12193 | gain | 1508 | TGFB1I1, ARMC5 | Exon+ve, ≥2 cases | Yes |
| 16 | 317 | 31485690 | 31487952 | 2262 | gain | 1524 | CSDAP1 | Exon+ve, ≥2 cases | Yes |
| 16 | 317 | 31485690 | 31487952 | 2262 | gain | 1618 | CSDAP1 | Exon+ve, ≥2 cases | Yes |
| 16 | 318 | 48955985 | 48960972 | 4987 | loss | 1395 | BRD7 | Exon+ve, ≥2 cases | Yes |
| 16 | 318 | 48955985 | 48960972 | 4987 | loss | 1409 | BRD7 | Exon+ve, ≥2 cases | Yes |
| 16 | 318 | 48955985 | 48960972 | 4987 | loss | 1428 | BRD7 | Exon+ve, ≥2 cases | Yes |
| 16 | 319 | 66834856 | 66838398 | 3542 | loss | 1858 | PLA2G15 | Exon+ve, ≥2 cases | Yes |
| 16 | 319 | 66834856 | 66838398 | 3542 | loss | 2023 | PLA2G15 | Exon+ve, ≥2 cases | Yes |
| 16 | 320 | 68844017 | 68850394 | 6377 | loss | 1538 | AARS | Exon+ve, ≥2 cases | Yes |
| 16 | 320 | 68844017 | 68850394 | 6377 | loss | 1793 | AARS | Exon+ve, ≥2 cases | Yes |
| 16 | 321 | 73303266 | 73305630 | 2364 | loss | 1293 | FA2H | Exon+ve, ≥2 cases | Yes |
| 16 | 321 | 73303266 | 73305630 | 2364 | loss | 1297 | FA2H | Exon+ve, ≥2 cases | Yes |
| 16 | 322 | 73305631 | 73315221 | 9590 | loss | 1293 | FA2H | Exon+ve, ≥2 cases | Yes |
| 16 | 322 | 73305631 | 73315221 | 9590 | loss | 1297 | FA2H | Exon+ve, ≥2 cases | Yes |
| 16 | 322 | 73305631 | 73315221 | 9590 | loss | 1918 | FA2H | Exon+ve, ≥2 cases | Yes |
| 16 | 323 | 74135000 | 74137609 | 2609 | gain | 1879 | TMEM231 | Exon+ve, ≥2 cases | Yes |
| 16 | 323 | 74135000 | 74137609 | 2609 | gain | 1993 | TMEM231 | Exon+ve, ≥2 cases | Yes |
| 16 | 323 | 74135000 | 74137609 | 2609 | gain | 2032 | TMEM231 | Exon+ve, ≥2 cases | Yes |
| 16 | 324 | 79711900 | 79713478 | 1578 | gain | 1763 | PKD1L2 | Exon+ve, distinct CNVs, same Gene | |
| 16 | 325 | 79730151 | 79735088 | 4937 | loss | 1404 | PKD1L2 | Exon+ve, distinct CNVs, same Gene | Yes |
| 16 | 326 | 79735089 | 79744613 | 9524 | loss | 1275 | PKD1L2 | Exon+ve, ≥2 cases | Yes |
| 16 | 326 | 79735089 | 79744613 | 9524 | loss | 1404 | PKD1L2 | Exon+ve, ≥2 cases | Yes |
| 16 | 326 | 79735089 | 79744613 | 9524 | loss | 1917 | PKD1L2 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 16 | 326 | 79735089 | 79744613 | 9524 | loss | 1998 | PKD1L2 | Exon+ve, ≥2 cases | Yes |
| 16 | 327 | 79744614 | 79747297 | 2683 | loss | 1917 | PKD1L2 | Exon+ve, distinct CNVs, same Gene | Yes |
| 16 | 328 | 79747298 | 79758149 | 10851 | gain | 1252 | PKD1L2 | Exon+ve, ≥2 cases | Yes |
| 16 | 328 | 79747298 | 79758149 | 10851 | loss | 1917 | PKD1L2 | Exon+ve, ≥2 cases | Yes |
| 16 | 329 | 79758150 | 79761753 | 3603 | gain | 1252 | PKD1L2 | Exon+ve, ≥2 cases | Yes |
| 16 | 329 | 79758150 | 79761753 | 3603 | gain | 1459 | PKD1L2 | Exon+ve, ≥2 cases | Yes |
| 16 | 329 | 79758150 | 79761753 | 3603 | loss | 1917 | PKD1L2 | Exon+ve, ≥2 cases | Yes |
| 16 | 330 | 79761754 | 79785859 | 24105 | gain | 1459 | PKD1L2 | Exon+ve, ≥2 cases | Yes |
| 16 | 330 | 79761754 | 79785859 | 24105 | loss | 1917 | PKD1L2 | Exon+ve, ≥2 cases | Yes |
| 16 | 331 | 81442167 | 81503479 | 61312 | loss | 1824 | CDH13 | Exon+ve, ≥2 cases | Yes |
| 16 | 331 | 81442167 | 81503479 | 61312 | gain | 1875 | CDH13 | Exon+ve, ≥2 cases | Yes |
| 16 | 332 | 86321579 | 86326794 | 5215 | loss | 1258 | KLHDC4 | Exon+ve, distinct CNVs, same Gene | Yes |
| 16 | 333 | 86347096 | 86364664 | 17568 | loss | 2041 | KLHDC4 | Exon+ve, distinct CNVs, same Gene | Yes |
| 16 | 334 | 88355436 | 88370375 | 14939 | loss | 1274 | FANCA | Exon+ve, distinct CNVs, same Gene | Yes |
| 16 | 335 | 88409839 | 88412033 | 2194 | gain | 1877 | FANCA | Exon+ve, distinct CNVs, same Gene | Yes |
| 17 | 336 | 423069 | 446585 | 23516 | loss | 1268 | VPS53 | Exon+ve, ≥2 cases | Yes |
| 17 | 336 | 423069 | 446585 | 23516 | gain | 1494 | VPS53 | Exon+ve, ≥2 cases | Yes |
| 17 | 337 | 6673256 | 6695979 | 22723 | gain | 1600 | TEKT1 | Exon+ve, ≥2 cases | Yes |
| 17 | 337 | 6673256 | 6695979 | 22723 | gain | 1927 | TEKT1 | Exon+ve, ≥2 cases | Yes |
| 17 | 338 | 6699298 | 6745640 | 46342 | loss | 1600 | ALOX12P2 | Exon+ve, ≥2 cases | Yes |
| 17 | 338 | 6699298 | 6745640 | 46342 | loss | 1927 | ALOX12P2 | Exon+ve, ≥2 cases | Yes |
| 17 | 339 | 18814921 | 18833619 | 18698 | gain | 1596 | SLC5A10, FAM83G | Exon+ve, ≥2 cases | Yes |
| 17 | 339 | 18814921 | 18833619 | 18698 | gain | 1717 | SLC5A10, FAM83G | Exon+ve, ≥2 cases | Yes |
| 17 | 340 | 18845632 | 18864625 | 18993 | gain | 1596 | SLC5A10, FAM83G | Exon+ve, ≥2 cases | Yes |
| 17 | 340 | 18845632 | 18864625 | 18993 | gain | 1717 | SLC5A10, FAM83G | Exon+ve, ≥2 cases | Yes |
| 17 | 341 | 19924055 | 19935009 | 10954 | loss | 2038 | SPECC1 | Exon+ve, distinct CNVs, same Gene | Yes |
| 17 | 342 | 20154473 | 20159997 | 5524 | loss | 1988 | SPECC1 | Exon+ve, distinct CNVs, same Gene | Yes |
| 17 | 343 | 26220790 | 26225329 | 4539 | loss | 1238 | ATAD5 | Exon+ve, ≥2 cases | Yes |
| 17 | 343 | 26220790 | 26225329 | 4539 | loss | 1831 | ATAD5 | Exon+ve, ≥2 cases | Yes |
| 17 | 344 | 26865992 | 26870510 | 4518 | loss | 1411 | RAB11FIP4 | Special | Yes |
| 17 | 345 | 35069605 | 35072082 | 2477 | loss | 1316 | STARD3 | Exon+ve, ≥2 cases | Yes |
| 17 | 345 | 35069605 | 35072082 | 2477 | loss | 1318 | STARD3 | Exon+ve, ≥2 cases | Yes |
| 17 | 345 | 35069605 | 35072082 | 2477 | loss | 1676 | STARD3 | Exon+ve, ≥2 cases | Yes |
| 17 | 345 | 35069605 | 35072082 | 2477 | loss | 2045 | STARD3 | Exon+ve, ≥2 cases | Yes |
| 17 | 346 | 35072083 | 35073438 | 1355 | loss | 1316 | STARD3 | Exon+ve, ≥2 cases | Yes |
| 17 | 346 | 35072083 | 35073438 | 1355 | loss | 1318 | STARD3 | Exon+ve, ≥2 cases | Yes |
| 17 | 346 | 35072083 | 35073438 | 1355 | loss | 1665 | STARD3 | Exon+ve, ≥2 cases | Yes |
| 17 | 346 | 35072083 | 35073438 | 1355 | loss | 1676 | STARD3 | Exon+ve, ≥2 cases | Yes |
| 17 | 346 | 35072083 | 35073438 | 1355 | loss | 2045 | STARD3 | Exon+ve, ≥2 cases | Yes |
| 17 | 347 | 37790601 | 37795135 | 4534 | loss | 1659 | STAT3 | Exon+ve, ≥2 cases | Yes |
| 17 | 347 | 37790601 | 37795135 | 4534 | loss | 1887 | STAT3 | Exon+ve, ≥2 cases | Yes |
| 17 | 348 | 38282993 | 38287021 | 4028 | loss | 1295 | LOC388387 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 17 | 348 | 38282993 | 38287021 | 4028 | loss | 1470 | LOC388387 | Exon+ve, ≥2 cases | Yes |
| 17 | 349 | 41514481 | 41518221 | 3740 | loss | 1319 | KIAA1267 | Exon+ve, ≥2 cases | Yes |
| 17 | 349 | 41514481 | 41518221 | 3740 | loss | 1320 | KIAA1267 | Exon+ve, ≥2 cases | Yes |
| 17 | 349 | 41514481 | 41518221 | 3740 | loss | 1530 | KIAA1267 | Exon+ve, ≥2 cases | Yes |
| 17 | 349 | 41514481 | 41518221 | 3740 | loss | 1533 | KIAA1267 | Exon+ve, ≥2 cases | Yes |
| 17 | 349 | 41514481 | 41518221 | 3740 | loss | 1535 | KIAA1267 | Exon+ve, ≥2 cases | Yes |
| 17 | 349 | 41514481 | 41518221 | 3740 | loss | 1536 | KIAA1267 | Exon+ve, ≥2 cases | Yes |
| 17 | 349 | 41514481 | 41518221 | 3740 | loss | 1537 | KIAA1267 | Exon+ve, ≥2 cases | Yes |
| 17 | 349 | 41514481 | 41518221 | 3740 | loss | 1539 | KIAA1267 | Exon+ve, ≥2 cases | Yes |
| 17 | 349 | 41514481 | 41518221 | 3740 | loss | 1542 | KIAA1267 | Exon+ve, ≥2 cases | Yes |
| 17 | 349 | 41514481 | 41518221 | 3740 | loss | 1586 | KIAA1267 | Exon+ve, ≥2 cases | Yes |
| 17 | 349 | 41514481 | 41518221 | 3740 | loss | 1587 | KIAA1267 | Exon+ve, ≥2 cases | Yes |
| 17 | 349 | 41514481 | 41518221 | 3740 | loss | 1655 | KIAA1267 | Exon+ve, ≥2 cases | Yes |
| 17 | 349 | 41514481 | 41518221 | 3740 | loss | 1656 | KIAA1267 | Exon+ve, ≥2 cases | Yes |
| 17 | 349 | 41514481 | 41518221 | 3740 | loss | 1662 | KIAA1267 | Exon+ve, ≥2 cases | Yes |
| 17 | 349 | 41514481 | 41518221 | 3740 | loss | 1684 | KIAA1267 | Exon+ve, ≥2 cases | Yes |
| 17 | 349 | 41514481 | 41518221 | 3740 | loss | 1861 | KIAA1267 | Exon+ve, ≥2 cases | Yes |
| 17 | 350 | 42143049 | 42147225 | 4176 | loss | 1536 | NSF | Exon+ve, ≥2 cases | Yes |
| 17 | 350 | 42143049 | 42147225 | 4176 | loss | 1671 | NSF | Exon+ve, ≥2 cases | Yes |
| 17 | 350 | 42143049 | 42147225 | 4176 | gain | 1751 | NSF | Exon+ve, ≥2 cases | Yes |
| 17 | 350 | 42143049 | 42147225 | 4176 | gain | 1800 | NSF | Exon+ve, ≥2 cases | Yes |
| 17 | 350 | 42143049 | 42147225 | 4176 | gain | 1991 | NSF | Exon+ve, ≥2 cases | Yes |
| 17 | 350 | 42143049 | 42147225 | 4176 | gain | 2032 | NSF | Exon+ve, ≥2 cases | Yes |
| 17 | 351 | 57327446 | 57329782 | 2336 | loss | 1439 | INTS2 | Exon+ve, ≥2 cases | Yes |
| 17 | 351 | 57327446 | 57329782 | 2336 | loss | 1601 | INTS2 | Exon+ve, ≥2 cases | Yes |
| 17 | 351 | 57327446 | 57329782 | 2336 | loss | 1641 | INTS2 | Exon+ve, ≥2 cases | Yes |
| 17 | 352 | 57329783 | 57331105 | 1322 | loss | 1439 | INTS2 | Exon+ve, ≥2 cases | Yes |
| 17 | 352 | 57329783 | 57331105 | 1322 | loss | 1601 | INTS2 | Exon+ve, ≥2 cases | Yes |
| 17 | 352 | 57329783 | 57331105 | 1322 | loss | 1641 | INTS2 | Exon+ve, ≥2 cases | Yes |
| 17 | 352 | 57329783 | 57331105 | 1322 | loss | 1784 | INTS2 | Exon+ve, ≥2 cases | Yes |
| 17 | 353 | 72982885 | 73000459 | 17574 | loss | 1825 | SEPT9 | Exon+ve, ≥2 cases | Yes |
| 17 | 353 | 72982885 | 73000459 | 17574 | loss | 1909 | SEPT9 | Exon+ve, ≥2 cases | Yes |
| 17 | 354 | 76954271 | 77777066 | 822795 | Gain | 1891 | C17orf70, ACTG1, TSPAN10, DCXR, C17orf90, STRA13, ARL16, MIR3186, NPLOC4, PYCR1, SLC25A10, GPS1, DUS1L, ANAPC11, LOC92659, FASN, ARHGDIA, MAFG, BAHCC1, DYSFIP1, MRPL12, SIRT7, RAC3, CCDC57, P4HB, PCYT2, HGS, RFNG, MYADML2, FSCN2, THOC4, ASPSCR1, CCDC137, NOTUM, NPB, PDE6G, LRRC45 | De Novo | Yes |
| 17 | 355 | 77787243 | 77847938 | 60695 | Loss | 1891 | SLC16A3, CSNK1D | De Novo | Yes |
| 18 | 356 | 17999811 | 18004912 | 5101 | loss | 1764 | GATA6 | Exon+ve, ≥2 cases | Yes |
| 18 | 356 | 17999811 | 18004912 | 5101 | loss | 1969 | GATA6 | Exon+ve, ≥2 cases | Yes |
| 18 | 357 | 22717441 | 22728600 | 11159 | loss | 1442 | C18orf16 | Exon+ve, ≥2 cases | Yes |
| 18 | 357 | 22717441 | 22728600 | 11159 | loss | 1502 | C18orf16 | Exon+ve, ≥2 cases | Yes |
| 19 | 358 | 11450908 | 11452390 | 1482 | gain | 1637 | ELAVL3 | Exon+ve, ≥2 cases | Yes |
| 19 | 358 | 11450908 | 11452390 | 1482 | gain | 1780 | ELAVL3 | Exon+ve, ≥2 cases | Yes |
| 19 | 358 | 11450908 | 11452390 | 1482 | gain | 1788 | ELAVL3 | Exon+ve, ≥2 cases | Yes |
| 19 | 358 | 11450908 | 11452390 | 1482 | gain | 1864 | ELAVL3 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 19 | 359 | 12026895 | 12036294 | 9399 | loss | 1333 | ZNF878 | Exon+ve, ≥2 cases | Yes |
| 19 | 359 | 12026895 | 12036294 | 9399 | loss | 1391 | ZNF878 | Exon+ve, ≥2 cases | Yes |
| 19 | 359 | 12026895 | 12036294 | 9399 | loss | 1742 | ZNF878 | Exon+ve, ≥2 cases | Yes |
| 19 | 360 | 12651862 | 12659347 | 7485 | loss | 1538 | DHPS | Exon+ve, ≥2 cases | Yes |
| 19 | 360 | 12651862 | 12659347 | 7485 | loss | 1638 | DHPS | Exon+ve, ≥2 cases | Yes |
| 19 | 361 | 14665135 | 14666402 | 1267 | loss | 1416 | ZNF333 | Exon+ve, ≥2 cases | Yes |
| 19 | 361 | 14665135 | 14666402 | 1267 | loss | 1578 | ZNF333 | Exon+ve, ≥2 cases | Yes |
| 19 | 361 | 14665135 | 14666402 | 1267 | loss | 1881 | ZNF333 | Exon+ve, ≥2 cases | Yes |
| 19 | 362 | 14666403 | 14667646 | 1243 | loss | 1416 | ZNF333 | Exon+ve, ≥2 cases | Yes |
| 19 | 362 | 14666403 | 14667646 | 1243 | loss | 1578 | ZNF333 | Exon+ve, ≥2 cases | Yes |
| 19 | 362 | 14666403 | 14667646 | 1243 | loss | 1677 | ZNF333 | Exon+ve, ≥2 cases | Yes |
| 19 | 362 | 14666403 | 14667646 | 1243 | loss | 1738 | ZNF333 | Exon+ve, ≥2 cases | Yes |
| 19 | 362 | 14666403 | 14667646 | 1243 | loss | 1775 | ZNF333 | Exon+ve, ≥2 cases | Yes |
| 19 | 362 | 14666403 | 14667646 | 1243 | loss | 1826 | ZNF333 | Exon+ve, ≥2 cases | Yes |
| 19 | 362 | 14666403 | 14667646 | 1243 | loss | 1837 | ZNF333 | Exon+ve, ≥2 cases | Yes |
| 19 | 362 | 14666403 | 14667646 | 1243 | loss | 1881 | ZNF333 | Exon+ve, ≥2 cases | Yes |
| 19 | 362 | 14666403 | 14667646 | 1243 | loss | 1957 | ZNF333 | Exon+ve, ≥2 cases | Yes |
| 19 | 362 | 14666403 | 14667646 | 1243 | loss | 1968 | ZNF333 | Exon+ve, ≥2 cases | Yes |
| 19 | 362 | 14666403 | 14667646 | 1243 | loss | 2004 | ZNF333 | Exon+ve, ≥2 cases | Yes |
| 19 | 362 | 14666403 | 14667646 | 1243 | loss | 2031 | ZNF333 | Exon+ve, ≥2 cases | Yes |
| 19 | 363 | 15420954 | 15422784 | 1830 | loss | 1471 | MIR1470, WIZ | Exon+ve, ≥2 cases | Yes |
| 19 | 363 | 15420954 | 15422784 | 1830 | loss | 1676 | MIR1470, WIZ | Exon+ve, ≥2 cases | Yes |
| 19 | 363 | 15420954 | 15422784 | 1830 | loss | 1687 | MIR1470, WIZ | Exon+ve, ≥2 cases | Yes |
| 19 | 363 | 15420954 | 15422784 | 1830 | loss | 1726 | MIR1470, WIZ | Exon+ve, ≥2 cases | Yes |
| 19 | 363 | 15420954 | 15422784 | 1830 | loss | 1887 | MIR1470, WIZ | Exon+ve, ≥2 cases | Yes |
| 19 | 364 | 20619921 | 20621911 | 1990 | gain | 1566 | ZNF626 | Exon+ve, ≥2 cases | Yes |
| 19 | 364 | 20619921 | 20621911 | 1990 | gain | 1761 | ZNF626 | Exon+ve, ≥2 cases | Yes |
| 19 | 365 | 23800105 | 23804481 | 4376 | gain | 1541 | RPSAP58 | Exon+ve, ≥2 cases | Yes |
| 19 | 365 | 23800105 | 23804481 | 4376 | gain | 1608 | RPSAP58 | Exon+ve, ≥2 cases | Yes |
| 19 | 365 | 23800105 | 23804481 | 4376 | gain | 1783 | RPSAP58 | Exon+ve, ≥2 cases | Yes |
| 19 | 366 | 47894889 | 47953617 | 58728 | gain | 1281 | PSG3, PSG8 | Exon+ve, ≥2 cases | Yes |
| 19 | 366 | 47894889 | 47953617 | 58728 | gain | 1282 | PSG3, PSG8 | Exon+ve, ≥2 cases | Yes |
| 19 | 367 | 53590042 | 53598814 | 8772 | loss | 1671 | GRIN2D | Exon+ve, ≥2 cases | Yes |
| 19 | 367 | 53590042 | 53598814 | 8772 | loss | 1901 | GRIN2D | Exon+ve, ≥2 cases | Yes |
| 19 | 367 | 53590042 | 53598814 | 8772 | loss | 1959 | GRIN2D | Exon+ve, ≥2 cases | Yes |
| 19 | 368 | 53896678 | 53899041 | 2363 | loss | 1227 | FUT2 | Exon+ve, ≥2 cases | Yes |
| 19 | 368 | 53896678 | 53899041 | 2363 | loss | 1448 | FUT2 | Exon+ve, ≥2 cases | Yes |
| 19 | 368 | 53896678 | 53899041 | 2363 | loss | 1694 | FUT2 | Exon+ve, ≥2 cases | Yes |
| 19 | 368 | 53896678 | 53899041 | 2363 | loss | 1697 | FUT2 | Exon+ve, ≥2 cases | Yes |
| 19 | 369 | 53900764 | 53901719 | 955 | loss | 1227 | FUT2 | Exon+ve, ≥2 cases | Yes |
| 19 | 369 | 53900764 | 53901719 | 955 | loss | 1448 | FUT2 | Exon+ve, ≥2 cases | Yes |
| 19 | 369 | 53900764 | 53901719 | 955 | loss | 1694 | FUT2 | Exon+ve, ≥2 cases | Yes |
| 19 | 369 | 53900764 | 53901719 | 955 | loss | 1697 | FUT2 | Exon+ve, ≥2 cases | Yes |
| 19 | 370 | 56882602 | 56889437 | 6835 | loss | 1232 | MIR99B, MIRLET7E, MIR125A, NCRNA00085 | Exon+ve, ≥2 cases | Yes |
| 19 | 370 | 56882602 | 56889437 | 6835 | loss | 1859 | MIR99B, MIRLET7E, MIR125A, NCRNA00085 | Exon+ve, ≥2 cases | Yes |
| 19 | 370 | 56882602 | 56889437 | 6835 | loss | 1965 | MIR99B, MIRLET7E, MIR125A, NCRNA00085 | Exon+ve, ≥2 cases | Yes |
| 19 | 370 | 56882602 | 56889437 | 6835 | loss | 1993 | MIR99B, MIRLET7E, MIR125A, NCRNA00085 | Exon+ve, ≥2 cases | Yes |
| 19 | 370 | 56882602 | 56889437 | 6835 | loss | 2032 | MIR99B, MIRLET7E, MIR125A, NCRNA00085 | Exon+ve, ≥2 cases | Yes |
| 19 | 371 | 57718358 | 57733017 | 14659 | loss | 1678 | ZNF808 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 19 | 371 | 57718358 | 57733017 | 14659 | loss | 1855 | ZNF808 | Exon+ve, ≥2 cases | Yes |
| 19 | 372 | 58919358 | 58920522 | 1164 | gain | 1585 | MIR516B2 | Exon+ve, ≥2 cases | Yes |
| 19 | 372 | 58919358 | 58920522 | 1164 | gain | 1606 | MIR516B2 | Exon+ve, ≥2 cases | Yes |
| 19 | 373 | 59177873 | 59179145 | 1272 | loss | 1720 | CACNG8 | Exon+ve, ≥2 cases | Yes |
| 19 | 373 | 59177873 | 59179145 | 1272 | loss | 1859 | CACNG8 | Exon+ve, ≥2 cases | Yes |
| 19 | 374 | 59179146 | 59180502 | 1356 | loss | 1720 | CACNG8 | Exon+ve, ≥2 cases | Yes |
| 19 | 374 | 59179146 | 59180502 | 1356 | loss | 1859 | CACNG8 | Exon+ve, ≥2 cases | Yes |
| 19 | 374 | 59179146 | 59180502 | 1356 | loss | 1953 | CACNG8 | Exon+ve, ≥2 cases | Yes |
| 19 | 375 | 59180503 | 59183718 | 3215 | loss | 1720 | CACNG8 | Exon+ve, ≥2 cases | Yes |
| 19 | 375 | 59180503 | 59183718 | 3215 | loss | 1859 | CACNG8 | Exon+ve, ≥2 cases | Yes |
| 19 | 375 | 59180503 | 59183718 | 3215 | loss | 1953 | CACNG8 | Exon+ve, ≥2 cases | Yes |
| 19 | 375 | 59180503 | 59183718 | 3215 | loss | 1966 | CACNG8 | Exon+ve, ≥2 cases | Yes |
| 19 | 376 | 62343981 | 62349061 | 5080 | loss | 1461 | ZIM3 | Exon+ve, ≥2 cases | Yes |
| 19 | 376 | 62343981 | 62349061 | 5080 | loss | 1995 | ZIM3 | Exon+ve, ≥2 cases | Yes |
| 19 | 376 | 62343981 | 62349061 | 5080 | loss | 1996 | ZIM3 | Exon+ve, ≥2 cases | Yes |
| 19 | 377 | 62653275 | 62660645 | 7370 | loss | 1461 | VN1R1 | Exon+ve, ≥2 cases | Yes |
| 19 | 377 | 62653275 | 62660645 | 7370 | loss | 1522 | VN1R1 | Exon+ve, ≥2 cases | Yes |
| 19 | 378 | 63655893 | 63669151 | 13258 | loss | 1454 | ZNF324B | Exon+ve, ≥2 cases | Yes |
| 19 | 378 | 63655893 | 63669151 | 13258 | gain | 1862 | ZNF324B | Exon+ve, ≥2 cases | Yes |
| 20 | 379 | 26127265 | 26144660 | 17395 | gain | 1694 | MIR663 | Exon+ve, ≥2 cases | Yes |
| 20 | 379 | 26127265 | 26144660 | 17395 | gain | 1793 | MIR663 | Exon+ve, ≥2 cases | Yes |
| 20 | 380 | 30793762 | 30795954 | 2192 | loss | 1241 | COMMD7 | Exon+ve, ≥2 cases | Yes |
| 20 | 380 | 30793762 | 30795954 | 2192 | loss | 1901 | COMMD7 | Exon+ve, ≥2 cases | Yes |
| 20 | 381 | 33633288 | 33634683 | 1395 | loss | 1419 | FER1L4 | Exon+ve, ≥2 cases | Yes |
| 20 | 381 | 33633288 | 33634683 | 1395 | loss | 1774 | FER1L4 | Exon+ve, ≥2 cases | Yes |
| 20 | 382 | 52074911 | 52078883 | 3972 | loss | 1354 | BCAS1 | Exon+ve, ≥2 cases | Yes |
| 20 | 382 | 52074911 | 52078883 | 3972 | loss | 1860 | BCAS1 | Exon+ve, ≥2 cases | Yes |
| 21 | 383 | 27260832 | 27262559 | 1727 | loss | 1442 | ADAMTS5 | Exon+ve, ≥2 cases | Yes |
| 21 | 383 | 27260832 | 27262559 | 1727 | loss | 1522 | ADAMTS5 | Exon+ve, ≥2 cases | Yes |
| 21 | 383 | 27260832 | 27262559 | 1727 | loss | 1714 | ADAMTS5 | Exon+ve, ≥2 cases | Yes |
| 21 | 383 | 27260832 | 27262559 | 1727 | loss | 1828 | ADAMTS5 | Exon+ve, ≥2 cases | Yes |
| 21 | 383 | 27260832 | 27262559 | 1727 | loss | 1915 | ADAMTS5 | Exon+ve, ≥2 cases | Yes |
| 22 | 384 | 16366605 | 16373481 | 6876 | loss | 1226 | CECR2 | Exon+ve, ≥2 cases | Yes |
| 22 | 384 | 16366605 | 16373481 | 6876 | loss | 1694 | CECR2 | Exon+ve, ≥2 cases | Yes |
| 22 | 385 | 16635762 | 16642926 | 7164 | loss | 1718 | BID | Exon+ve, ≥2 cases | Yes |
| 22 | 385 | 16635762 | 16642926 | 7164 | loss | 1859 | BID | Exon+ve, ≥2 cases | Yes |
| 22 | 386 | 16661122 | 16680825 | 19703 | loss | 1780 | MICAL3 | Exon+ve, ≥2 cases | Yes |
| 22 | 386 | 16661122 | 16680825 | 19703 | loss | 1805 | MICAL3 | Exon+ve, ≥2 cases | Yes |
| 22 | 386 | 16661122 | 16680825 | 19703 | loss | 2034 | MICAL3 | Exon+ve, ≥2 cases | Yes |
| 22 | 387 | 22324940 | 22354944 | 30004 | loss | 1549 | LOC91316 | Exon+ve, distinct CNVs, same Gene | Yes |
| 22 | 388 | 22362348 | 22369101 | 6753 | gain | 1895 | LOC91316, RGL4 | Exon+ve, distinct CNVs, same Gene | Yes |
| 22 | 389 | 24636477 | 24646275 | 9798 | gain | 1348 | MIR1302-1, MYO18B | Exon+ve, ≥2 cases | Yes |
| 22 | 389 | 24636477 | 24646275 | 9798 | loss | 1833 | MIR1302-1, MYO18B | Exon+ve, ≥2 cases | Yes |
| 22 | 390 | 34951404 | 34973305 | 21901 | loss | 1724 | APOL2 | Exon+ve, ≥2 cases | Yes |
| 22 | 390 | 34951404 | 34973305 | 21901 | loss | 2035 | APOL2 | Exon+ve, ≥2 cases | Yes |
| 22 | 391 | 37737241 | 37740258 | 3017 | loss | 1959 | APOBEC3C | Exon+ve, ≥2 cases | Yes |
| 22 | 391 | 37737241 | 37740258 | 3017 | loss | 1965 | APOBEC3C | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| 22 | 392 | 45453176 | 45454102 | 926 | gain | 1660 | GRAMD4 | Exon+ve, ≥2 cases | Yes |
| 22 | 392 | 45453176 | 45454102 | 926 | gain | 1880 | GRAMD4 | Exon+ve, ≥2 cases | Yes |
| 22 | 393 | 48680818 | 48687314 | 6496 | loss | 1619 | ALG12 | Exon+ve, ≥2 cases | Yes |
| 22 | 393 | 48680818 | 48687314 | 6496 | loss | 1930 | ALG12 | Exon+ve, ≥2 cases | Yes |
| X | 394 | 2742852 | 2743950 | 1098 | gain | 1434 | XG | Exon+ve, ≥2 cases | Yes |
| X | 394 | 2742852 | 2743950 | 1098 | gain | 1509 | XG | Exon+ve, ≥2 cases | Yes |
| X | 394 | 2742852 | 2743950 | 1098 | gain | 1732 | XG | Exon+ve, ≥2 cases | Yes |
| X | 394 | 2742852 | 2743950 | 1098 | gain | 1825 | XG | Exon+ve, ≥2 cases | Yes |
| X | 394 | 2742852 | 2743950 | 1098 | gain | 1917 | XG | Exon+ve, ≥2 cases | Yes |
| X | 395 | 2749116 | 2768212 | 19096 | gain | 1434 | GYG2 | Exon+ve, ≥2 cases | Yes |
| X | 395 | 2749116 | 2768212 | 19096 | gain | 1509 | GYG2 | Exon+ve, ≥2 cases | Yes |
| X | 395 | 2749116 | 2768212 | 19096 | gain | 1732 | GYG2 | Exon+ve, ≥2 cases | Yes |
| X | 395 | 2749116 | 2768212 | 19096 | gain | 1825 | GYG2 | Exon+ve, ≥2 cases | Yes |
| X | 395 | 2749116 | 2768212 | 19096 | gain | 1917 | GYG2 | Exon+ve, ≥2 cases | Yes |
| X | 396 | 2768213 | 2788489 | 20276 | loss | 1654 | GYG2 | Exon+ve, ≥2 cases | Yes |
| X | 396 | 2768213 | 2788489 | 20276 | gain | 1732 | GYG2 | Exon+ve, ≥2 cases | Yes |
| X | 396 | 2768213 | 2788489 | 20276 | gain | 1825 | GYG2 | Exon+ve, ≥2 cases | Yes |
| X | 396 | 2768213 | 2788489 | 20276 | gain | 1917 | GYG2 | Exon+ve, ≥2 cases | Yes |
| X | 397 | 2788490 | 2814330 | 25840 | gain | 1434 | GYG2 | Exon+ve, ≥2 cases | Yes |
| X | 397 | 2788490 | 2814330 | 25840 | gain | 1509 | GYG2 | Exon+ve, ≥2 cases | Yes |
| X | 397 | 2788490 | 2814330 | 25840 | gain | 1732 | GYG2 | Exon+ve, ≥2 cases | Yes |
| X | 397 | 2788490 | 2814330 | 25840 | gain | 1825 | GYG2 | Exon+ve, ≥2 cases | Yes |
| X | 397 | 2788490 | 2814330 | 25840 | gain | 1917 | GYG2 | Exon+ve, ≥2 cases | Yes |
| X | 398 | 8397975 | 8463130 | 65155 | gain | 1566 | KAL1 | Exon+ve, ≥2 cases | Yes |
| X | 398 | 8397975 | 8463130 | 65155 | gain | 1901 | KAL1 | Exon+ve, ≥2 cases | Yes |
| X | 399 | 8463131 | 8473482 | 10351 | loss | 1298 | KAL1 | Exon+ve, ≥2 cases | Yes |
| X | 399 | 8463131 | 8473482 | 10351 | gain | 1432 | KAL1 | Exon+ve, ≥2 cases | Yes |
| X | 399 | 8463131 | 8473482 | 10351 | gain | 1566 | KAL1 | Exon+ve, ≥2 cases | Yes |
| X | 399 | 8463131 | 8473482 | 10351 | gain | 1901 | KAL1 | Exon+ve, ≥2 cases | Yes |
| X | 400 | 8473483 | 8531260 | 57777 | gain | 1566 | KAL1 | Exon+ve, ≥2 cases | Yes |
| X | 400 | 8473483 | 8531260 | 57777 | gain | 1901 | KAL1 | Exon+ve, ≥2 cases | Yes |
| X | 401 | 8532842 | 8553485 | 20643 | gain | 1566 | KAL1 | Exon+ve, ≥2 cases | Yes |
| X | 401 | 8532842 | 8553485 | 20643 | gain | 1901 | KAL1 | Exon+ve, ≥2 cases | Yes |
| X | 402 | 8931895 | 8958319 | 26424 | loss | 1496 | FAM9B | Exon+ve, ≥2 cases | Yes |
| X | 403 | 8960105 | 8963721 | 3616 | gain | 1454 | FAM9B | Exon+ve, ≥2 cases | Yes |
| X | 404 | 12833576 | 12834706 | 1130 | loss | 1633 | TLR8, LOC349408 | Exon+ve, ≥2 cases | Yes |
| X | 404 | 12833576 | 12834706 | 1130 | loss | 1901 | TLR8, LOC349408 | Exon+ve, ≥2 cases | Yes |
| X | 404 | 12833576 | 12834706 | 1130 | loss | 2024 | TLR8, LOC349408 | Exon+ve, ≥2 cases | Yes |
| X | 405 | 13673158 | 13674550 | 1392 | loss | 1320 | OFD1 | Exon+ve, ≥2 cases | Yes |
| X | 406 | 13695016 | 13696059 | 1043 | gain | 1590 | OFD1 | Exon+ve, ≥2 cases | Yes |
| X | 407 | 15463254 | 15464663 | 1409 | loss | 1234 | BMX | Exon+ve, ≥2 cases | Yes |
| X | 407 | 15463254 | 15464663 | 1409 | loss | 1320 | BMX | Exon+ve, ≥2 cases | Yes |
| X | 407 | 15463254 | 15464663 | 1409 | loss | 1822 | BMX | Exon+ve, ≥2 cases | Yes |
| X | 407 | 15463254 | 15464663 | 1409 | loss | 1827 | BMX | Exon+ve, ≥2 cases | Yes |
| X | 407 | 15463254 | 15464663 | 1409 | loss | 1876 | BMX | Exon+ve, ≥2 cases | Yes |
| X | 408 | 29595687 | 29597689 | 2002 | loss | 1506 | IL1RAPL1 | Exon+ve, ≥2 cases | Yes |
| X | 408 | 29595687 | 29597689 | 2002 | loss | 1811 | IL1RAPL1 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| X | 409 | 32210107 | 32228244 | 18137 | gain | 2018 | DMD | Exon+ve, ≥2 cases | Yes |
| X | 410 | 32958581 | 33069843 | 111262 | gain | 1864 | DMD | Exon+ve, ≥2 cases | Yes |
| X | 411 | 33074762 | 33228204 | 153442 | gain | 1864 | DMD | Exon+ve, ≥2 cases | Yes |
| X | 412 | 33230517 | 33336759 | 106242 | gain | 1864 | DMD | Exon+ve, ≥2 cases | Yes |
| X | 413 | 40938342 | 40940809 | 2467 | loss | 1415 | USP9X | Exon+ve, ≥2 cases | Yes |
| X | 414 | 40940810 | 40942301 | 1491 | loss | 1415 | USP9X | Exon+ve, ≥2 cases | Yes |
| X | 414 | 40940810 | 40942301 | 1491 | loss | 1583 | USP9X | Exon+ve, ≥2 cases | Yes |
| X | 415 | 43457175 | 43465307 | 8132 | Loss | 1369 | MAOA | Intronic | No |
| X | 416 | 43458232 | 43465307 | 7075 | Loss | 1300 | MAOA | Intronic | No |
| X | 416 | 43458232 | 43465307 | 7075 | Loss | 1697 | MAOA | Intronic | No |
| X | 416 | 43458232 | 43465307 | 7075 | Loss | 1751 | MAOA | Intronic | No |
| X | 416 | 43458232 | 43465307 | 7075 | Loss | 1800 | MAOA | Intronic | No |
| X | 416 | 43458232 | 43465307 | 7075 | Loss | 1842 | MAOA | Intronic | No |
| X | 416 | 43458232 | 43465307 | 7075 | Loss | 1848 | MAOA | Intronic | No |
| X | 416 | 43458232 | 43465307 | 7075 | Loss | 1855 | MAOA | Intronic | No |
| X | 416 | 43458232 | 43465307 | 7075 | Loss | 1859 | MAOA | Intronic | No |
| X | 416 | 43458232 | 43465307 | 7075 | Loss | 1898 | MAOA | Intronic | No |
| X | 416 | 43458232 | 43465307 | 7075 | Loss | 1907 | MAOA | Intronic | No |
| X | 416 | 43458232 | 43465307 | 7075 | Loss | 1916 | MAOA | Intronic | No |
| X | 416 | 43458232 | 43465307 | 7075 | Loss | 1921 | MAOA | Intronic | No |
| X | 416 | 43458232 | 43465307 | 7075 | Loss | 1935 | MAOA | Intronic | No |
| X | 416 | 43458232 | 43465307 | 7075 | Loss | 1946 | MAOA | Intronic | No |
| X | 416 | 43458232 | 43465307 | 7075 | Loss | 1958 | MAOA | Intronic | No |
| X | 416 | 43458232 | 43465307 | 7075 | Loss | 1960 | MAOA | Intronic | No |
| X | 416 | 43458232 | 43465307 | 7075 | Loss | 1961 | MAOA | Intronic | No |
| X | 416 | 43458232 | 43465307 | 7075 | Loss | 1965 | MAOA | Intronic | No |
| X | 416 | 43458232 | 43465307 | 7075 | Loss | 1966 | MAOA | Intronic | No |
| X | 416 | 43458232 | 43465307 | 7075 | Loss | 1967 | MAOA | Intronic | No |
| X | 416 | 43458232 | 43465307 | 7075 | Loss | 1969 | MAOA | Intronic | No |
| X | 416 | 43458232 | 43465307 | 7075 | Loss | 1993 | MAOA | Intronic | No |
| X | 416 | 43458232 | 43465307 | 7075 | Loss | 2033 | MAOA | Intronic | No |
| X | 416 | 43458232 | 43465307 | 7075 | Loss | 2035 | MAOA | Intronic | No |
| X | 417 | 46832380 | 46837814 | 5434 | loss | 1675 | RGN | Exon+ve, ≥2 cases | Yes |
| X | 417 | 46832380 | 46837814 | 5434 | gain | 1896 | RGN | Exon+ve, ≥2 cases | Yes |
| X | 417 | 46832380 | 46837814 | 5434 | gain | 2040 | RGN | Exon+ve, ≥2 cases | Yes |
| X | 418 | 48688957 | 48716140 | 27183 | gain | 1349 | KCND1, OTUD5, GRIPAP1 | Exon+ve, ≥2 cases | Yes |
| X | 418 | 48688957 | 48716140 | 27183 | loss | 1639 | KCND1, OTUD5, GRIPAP1 | Exon+ve, ≥2 cases | Yes |
| X | 419 | 70060068 | 70062203 | 2135 | gain | 1284 | SLC7A3 | Exon+ve, ≥2 cases | Yes |
| X | 419 | 70060068 | 70062203 | 2135 | gain | 1308 | SLC7A3 | Exon+ve, ≥2 cases | Yes |
| X | 419 | 70060068 | 70062203 | 2135 | gain | 1346 | SLC7A3 | Exon+ve, ≥2 cases | Yes |
| X | 420 | 96561809 | 96658023 | 96214 | gain | 1348 | DIAPH2 | Exon+ve, ≥2 cases | Yes |
| X | 421 | 96718563 | 97203519 | 484956 | gain | 1348 | DIAPH2 | Exon+ve, ≥2 cases | Yes |
| X | 422 | 100665462 | 100673058 | 7596 | loss | 1269 | ARMCX4 | Exon+ve, ≥2 cases | Yes |
| X | 422 | 100665462 | 100673058 | 7596 | loss | 1413 | ARMCX4 | Exon+ve, ≥2 cases | Yes |
| X | 422 | 100665462 | 100673058 | 7596 | gain | 1857 | ARMCX4 | Exon+ve, ≥2 cases | Yes |
| X | 423 | 105750701 | 105752733 | 2032 | loss | 1239 | CXorf57 | Exon+ve, ≥2 cases | Yes |
| X | 423 | 105750701 | 105752733 | 2032 | loss | 1372 | CXorf57 | Exon+ve, ≥2 cases | Yes |
| X | 424 | 123691710 | 123698719 | 7009 | loss | 1421 | ODZ1 | Exon+ve, ≥2 cases | Yes |
| X | 424 | 123691710 | 123698719 | 7009 | loss | 1428 | ODZ1 | Exon+ve, ≥2 cases | Yes |

TABLE 2-continued

| Chr | Subregion ID # | CNV Subregion Start | CNV Subregion Stop | CNV Subregion Size | CNV type | ASD Case ID(s) | RefSeq Gene Symbol(s) | Category | Exon overlap |
|---|---|---|---|---|---|---|---|---|---|
| X | 424 | 123691710 | 123698719 | 7009 | loss | 1805 | ODZ1 | Exon+ve, ≥2 cases | Yes |
| X | 425 | 128772381 | 128775324 | 2943 | gain | 1806 | ZDHHC9 | Exon+ve, ≥2 cases | Yes |
| X | 425 | 128772381 | 128775324 | 2943 | gain | 1824 | ZDHHC9 | Exon+ve, ≥2 cases | Yes |
| X | 426 | 128775325 | 128777107 | 1782 | gain | 1459 | ZDHHC9 | Exon+ve, ≥2 cases | Yes |
| X | 426 | 128775325 | 128777107 | 1782 | gain | 1806 | ZDHHC9 | Exon+ve, ≥2 cases | Yes |
| X | 426 | 128775325 | 128777107 | 1782 | gain | 1824 | ZDHHC9 | Exon+ve, ≥2 cases | Yes |
| X | 427 | 137525298 | 137527811 | 2513 | gain | 1223 | LOC158696 | Exon+ve, ≥2 cases | Yes |
| X | 427 | 137525298 | 137527811 | 2513 | gain | 2041 | LOC158696 | Exon+ve, ≥2 cases | Yes |
| X | 428 | 151736328 | 151770679 | 34351 | gain | 1887 | CETN2, NSDHL | Exon+ve, ≥2 cases | Yes |
| X | 429 | 151788383 | 151853605 | 65222 | gain | 1887 | ZNF185, NSDHL | Exon+ve, ≥2 cases | Yes |
| X | 430 | 154321522 | 154375563 | 54041 | gain | 1831 | F8A1, F8A3, F8A2, H2AFB3, H2AFB2, H2AFB1, MIR1184-1, MIR1184-2, MIR1184-3, TMLHE | Exon+ve, ≥2 cases | Yes |
| X | 431 | 154404962 | 154427678 | 22716 | gain | 1724 | TMLHE | Exon+ve, ≥2 cases | Yes |

* Position references refer to the human genomic sequence Hg18 Mar. 2006 (NCBI Build 36.1).

Table 2 is identical to Table 1, with four exceptions. Firstly, the CNV coordinates listed refer to the actual CNV subregions found to be unique or significantly different in frequency between ASD and Normal cohorts, as opposed to Table 1, which lists the originating CNVs. For example, a CNV of a particular size/length (e.g., 100,000 bp) in an ASD patient may contain one or more smaller subregions within it (e.g., 10,000 bp in size/length) that do not occur at higher frequency in one or more ASD patients relative to the normal cohort. Another example is that a CNV unique to, or present at higher frequency in, ASD patients relative to normal subjects may partially overlap a second CNV that is present at comparable or higher frequency in normal subjects; in this case, only the unique subregion is reported in Table 2 as such subregions may further refine specific genomic loci causative of autism/ASD phenotypes. Secondly, an extra column details whether the CNV subregion of interest overlaps an exon or only an intron. Thirdly, no OR values are reported (see Table 1 for OR values). Fourthly, gene annotation is for CNV subregions only (i.e., other genes that may be impacted by the parent CNV reported in Table 1 are excluded if they are not likewise impacted by the CNV subregion(s)). "De novo" refers to CNV subregions found to occur in the offspring of two parents, neither of whom has the relevant CNV subregion(s); "Intronic" refers to CNV subregions affecting introns only; "Ctrl pos High OR" refers to CNV subregions present at high frequency in the ASD cohort compared to the normal cohort; "Exon+ve, distinct CNVs, same Gene" refers to CNV subregions in 2 or more ASD individuals affecting different exons of the same gene; "Exon+ve,≥2 cases" refers to CNV subregions in 2 or more ASD individuals affecting the same exon of a gene; "Special" refers to CNV subregions added to list because of relationship to genes with strong biological evidence in ASD.

Column 2 refers to the nucleotide position in the respective chromosome (column 1) where the corresponding CNV subregion begins and column 3 refers to the nucleotide position in the respective chromosome where the corresponding CNV subregion ends. Column 4 refers to the length of the CNV subregion in bps. Nucleotide positions were determined using the database Hg18 Mar. 2006 (NCBI Build 36.1). The CNV classifications of gain or loss indicate whether each CNV subregion found in the subjects was duplicated/amplified (gain) or deleted (loss) in the genome.

TABLE 3

| GENE NAME | Gene ID # | CNV Gene Region | NCBI Gene ID | Gene Description | RefSeq Summmary |
|---|---|---|---|---|---|
| AARS | 1 | Exonic | 16 | alanyl-tRNA synthetase, cytoplasmic | The human alanyl-tRNA synthetase (AARS) belongs to a family of tRNA synthetases, of the class II enzymes. Class II tRNA synthases evolved early in evolution and are highly conserved. This is reflected by the fact that 498 of the 968-residue polypeptide human AARS shares 41% identity with the E. coli protein. tRNA synthases are the enzymes that interpret the RNA code and attach specific aminoacids to the tRNAs that contain the cognate trinucleotide anticodons. They consist of a catalytic domain which interacts with the amino acid acceptor-T psi C helix of the tRNA, and a second domain which interacts with the rest of the tRNA structure. [provided by RefSeq, July 2008]. |
| ABCA13 | 2 | Exonic | 154664 | ATP-binding cassette sub-family A member 13 | In human, the ATP-binding cassette (ABC) family of transmembrane transporters has at least 48 genes and 7 gene subfamilies. This gene is a member of ABC gene subfamily A (ABCA). Genes within the ABCA family typically encode several thousand amino acids. Like other ABC transmembrane transporter proteins, this protein has 12 or more transmembrane alpha-helix domains that likely arrange to form a single central chamber with multiple substrate binding sites. It is also predicted to have two large extracellular domains and two nucleotide binding domains as is typical for ABCA proteins. Alternative splice variants have been described but their biological validity has not been demonstrated. [provided by RefSeq, March 2009]. Sequence Note: This RefSeq record was created from transcript and genomic sequence data to make the sequence consistent with the reference genome assembly. The genomic coordinates used for the transcript record were based on transcript alignments. |
| ABCB4 | 3 | Exonic | 5244 | multidrug resistance protein 3 isoform B | The membrane-associated protein encoded by this gene is a member of the superfamily of ATP-binding cassette (ABC) transporters. ABC proteins transport various molecules across extra- and intra-cellular membranes. ABC genes are divided into seven distinct subfamilies (ABC1, MDR/TAP, MRP, ALD, OABP, GCN20, White). This protein is a member of the MDR/TAP subfamily. Members of the MDR/TAP subfamily are involved in multidrug resistance as well as antigen presentation. This gene encodes a full transporter and member of the p-glycoprotein family of membrane proteins with phosphatidylcholine as its substrate. The function of this protein has not yet been determined; however, it may involve transport of phospholipids from liver hepatocytes into bile. Alternative splicing of this gene results in several products of undetermined function. [provided by RefSeq, July 2008]. Transcript Variant: This variant (B) uses an alternate in-frame splice site in the 3' coding region, compared to variant A, resulting in a longer protein (isoform B). |
| ACAD10 | 4 | Exonic | 80724 | acyl-CoA dehydrogenase family member 10 isoform a | This gene encodes a member of the acyl-CoA dehydrogenase family of enzymes (ACADs), which participate in the beta-oxidation of fatty acids in mitochondria. The encoded enzyme contains a hydrolase domain at the N-terminal portion, a serine/threonine protein kinase catlytic domain in the central region, and a conserved ACAD domain at the C-terminus. Several alternatively spliced transcript variants of this gene have been described, but the full-length nature of some of these variants has not been determined. [provided by RefSeq, November 2008]. Transcript Variant: This variant (1) represents the longest transcript and encodes the longest isoform (a). |
| ACTG1 | 5 | Exonic | 71 | actin, cytoplasmic 2 | Actins are highly conserved proteins that are involved in various types of cell motility, and maintenance of the cytoskeleton. In vertebrates, three main groups |

TABLE 3-continued

| GENE NAME | Gene ID # | CNV Gene Region | NCBI Gene ID | Gene Description | RefSeq Summmary |
|---|---|---|---|---|---|
| | | | | | of actin isoforms, alpha, beta and gamma have been identified. The alpha actins are found in muscle tissues and are a major constituent of the contractile apparatus. The beta and gamma actins co-exist in most cell types as components of the cytoskeleton, and as mediators of internal cell motility. Actin, gamma 1, encoded by this gene, is a cytoplasmic actin found in non-muscle cells. Mutations in this gene are associated with DFNA20/26, a subtype of autosomal dominant non-syndromic sensorineural progressive hearing loss. Alternative splicing results in multiple transcript variants. [provided by RefSeq, January 2011]. Transcript Variant: This variant (1) represents the longest transcript. Variants 1 and 2 encode the same protein. |
| ADAMTS5 | 6 | Exonic | 11096 | A disintegrin and metalloproteinase with thrombospondin motifs 5 preproprotein | This gene encodes a member of the ADAMTS (a disintegrin and metalloproteinase with thrombospondin motifs) protein family. Members of the family share several distinct protein modules, including a propeptide region, a metalloproteinase domain, a disintegrin-like domain, and a thrombospondin type 1 (TS) motif. Individual members of this family differ in the number of C-terminal TS motifs, and some have unique C-terminal domains. The enzyme encoded by this gene contains two C-terminal TS motifs and functions as aggrecanase to cleave aggrecan, a major proteoglycan of cartilage. [provided by RefSeq, July 2008]. Sequence Note: The RefSeq transcript and protein were derived from genomic sequence to make the sequence consistent with the reference genome assembly. The genomic coordinates used for the transcript record were based on alignments. |
| ADAMTS9 | 7 | Exonic | 56999 | A disintegrin and metalloproteinase with thrombospondin motifs 9 preproprotein | This gene encodes a member of the ADAMTS (a disintegrin and metalloproteinase with thrombospondin motifs) protein family. Members of the family share several distinct protein modules, including a propeptide region, a metalloproteinase domain, a disintegrin-like domain, and a thrombospondin type 1 (TS) motif. Individual members of this family differ in the number of C-terminal TS motifs, and some have unique C-terminal domains. Members of the ADAMTS family have been implicated in the cleavage of proteoglycans, the control of organ shape during development, and the inhibition of angiogenesis. This gene is localized to chromosome 3p14.3-p14.2, an area known to be lost in hereditary renal tumors. [provided by RefSeq, July 2008]. |
| AIG1 | 8 | Exonic | 51390 | androgen-induced gene 1 protein | N/A |
| AKNA | 9 | Exonic | 80709 | AT-hook-containing transcription factor | N/A |
| AKR1B15 | 10 | Exonic | 441282 | aldo-keto reductase family 1 member B15 | N/A |
| ALB | 11 | Exonic | 213 | serum albumin preproprotein | Albumin is a soluble, monomeric protein which comprises about one-half of the blood serum protein. Albumin functions primarily as a carrier protein for steroids, fatty acids, and thyroid hormones and plays a role in stabilizing extracellular fluid volume. Albumin is a globular unglycosylated serum protein of molecular weight 65,000. Albumin is synthesized in the liver as preproalbumin which has an N-terminal peptide that is removed before the nascent protein is released from the rough endoplasmic reticulum. The product, proalbumin, is in turn cleaved from the Golgi vesicles to produce the secreted albumin. [provided by RefSeq, July 2008]. |

TABLE 3-continued

| GENE NAME | Gene ID # | CNV Gene Region | NCBI Gene ID | Gene Description | RefSeq Summary |
|---|---|---|---|---|---|
| ALDH1A2 | 12 | Exonic | 8854 | retinal dehydrogenase 2 isoform 3 | This protein belongs to the aldehyde dehydrogenase family of proteins. The product of this gene is an enzyme that catalyzes the synthesis of retinoic acid (RA) from retinaldehyde. Retinoic acid, the active derivative of vitamin A (retinol), is a hormonal signaling molecule that functions in developing and adult tissues. The studies of a similar mouse gene suggest that this enzyme and the cytochrome CYP26A1, concurrently establish local embryonic retinoic acid levels which facilitate posterior organ development and prevent spina bifida. Four transcript variants encoding distinct isoforms have been identified for this gene. [provided by RefSeq, May 2011]. Transcript Variant: This variant (3) differs in the 5' UTR and coding sequence compared to variant 1. The resulting isoform (3) is shorter at the N-terminus compared to isoform 1. |
| ALDH1A3 | 13 | Exonic | 220 | aldehyde dehydrogenase family 1 member A3 | Aldehyde dehydrogenase isozymes are thought to play a major role in the detoxification of aldehydes generated by alcohol metabolism and lipid peroxidation. The enzyme encoded by this gene uses retinal as a substrate, either in a free or cellular retinol-binding protein form. [provided by RefSeq, July 2008]. |
| ALDH2 | 14 | Exonic | 217 | aldehyde dehydrogenase, mitochondrial isoform 2 precursor | This protein belongs to the aldehyde dehydrogenase family of proteins. Aldehyde dehydrogenase is the second enzyme of the major oxidative pathway of alcohol metabolism. Two major liver isoforms of aldehyde dehydrogenase, cytosolic and mitochondrial, can be distinguished by their electrophoretic mobilities, kinetic properties, and subcellular localizations. Most Caucasians have two major isozymes, while approximately 50% of Orientals have the cytosolic isozyme but not the mitochondrial isozyme. A remarkably higher frequency of acute alcohol intoxication among Orientals than among Caucasians could be related to the absence of a catalytically active form of the mitochondrial isozyme. The increased exposure to acetaldehyde in individuals with the catalytically inactive form may also confer greater susceptibility to many types of cancer. This gene encodes a mitochondrial isoform, which has a low Km for acetaldehydes, and is localized in mitochondrial matrix. Alternative splicing results in multiple transcript variants encoding distinct isoforms. [provided by RefSeq, March 2011]. Transcript Variant: This variant (2) lacks an in-frame exon in the 5' coding region, compared to variant 1, and encodes a shorter isoform (2), compared to isoform 1. |
| ALG12 | 15 | Exonic | 79087 | dol-P-Man:Man(7)-GlcNAc(2)-PP-Dol alpha-1,6-mannosyltransferase | This gene encodes a member of the glycosyltransferase 22 family. The encoded protein catalyzes the addition of the eighth mannose residue in an alpha-1,6 linkage onto the dolichol-PP-oligosaccharide precursor (dolichol-PP-Man(7)GlcNAc(2)) required for protein glycosylation. Mutations in this gene have been associated with congenital disorder of glycosylation type Ig (CDG-Ig)characterized by abnormal N-glycosylation. [provided by RefSeq, July 2008]. |
| ALMS1P | 16 | Exonic | 200420 | N/A | N/A |
| ALOX12P2 | 17 | Exonic | 245 | N/A | N/A |
| ALS2CL | 18 | Exonic | 259173 | ALS2 C-terminal-like protein isoform 3 | N/A |
| AMBP | 19 | Exonic | 259 | protein AMBP preproprotein | This gene encodes a complex glycoprotein secreted in plasma. The precursor is proteolytically processed into distinct functioning proteins: alpha-1-microglobulin, which belongs to the superfamily of lipocalin transport proteins and may play a role in the regulation of inflammatory processes, and bikunin, which is a urinary trypsin inhibitor belonging to the superfamily of Kunitz-type protease inhibitors and plays an important role in many physiological and |

TABLE 3-continued

| GENE NAME | Gene ID # | CNV Gene Region | NCBI Gene ID | Gene Description | RefSeq Summmary |
|---|---|---|---|---|---|
| ANAPC11 | 20 | Exonic | 51529 | anaphase-promoting complex subunit 11 isoform 2 | pathological processes. This gene is located on chromosome 9 in a cluster of lipocalin genes. [provided by RefSeq, July 2008].<br>N/A |
| ANKRD17 | 21 | Exonic | 26057 | ankyrin repeat domain-containing protein 17 isoform b | This gene encodes a protein with ankyrin repeats, which are associated with protein-protein interactions. Studies in mice suggest that this protein is involved in liver development. Two transcript variants encoding different isoforms have been found for this gene. [provided by RefSeq, July 2008]. Transcript Variant: This variant (2) lacks an alternate in-frame exon compared to variant 1. The resulting isoform (b) has the same N- and C-termini but is shorter compared to isoform a. |
| ANKRD33 | 22 | Exonic | 341405 | ankyrin repeat domain-containing protein 33 isoform 2 | N/A |
| ANKRD33B | 23 | Exonic | 651746 | ankyrin repeat domain-containing protein 33B | N/A |
| ANKRD34A | 24 | Exonic | 284615 | ankyrin repeat domain-containing protein 34A | N/A |
| ANKRD35 | 25 | Exonic | 148741 | ankyrin repeat domain-containing protein 35 | N/A |
| ANKS1B | 26 | Exonic | 56899 | ankyrin repeat and sterile alpha motif domain-containing protein 1B isoform 1 | This gene encodes a multi-domain protein that is predominantly expressed in brain and testis. This protein interacts with amyloid beta protein precursor (AbetaPP) and may have a role in normal brain development, and in the pathogenesis of Alzheimer's disease. Expression of this gene has been shown to be elevated in patients with pre-B cell acute lymphocytic leukemia associated with t(1; 19) translocation. Alternatively spliced transcript variants encoding different isoforms (some with different subcellular localization, PMID: 15004329) have been described for this gene. [provided by RefSeq, August 2011]. Transcript Variant: This variant (12) differs in the 5′ UTR and coding region compared to variant 1. The resulting isoform (1) has a shorter and distinct N-terminus compared to isoform a. Publication Note: This RefSeq record includes a subset of the publications that are available for this gene. Please see the Gene record to access additional publications. |
| ANO5 | 27 | Exonic | 203859 | anoctamin-5 isoform b | This gene encodes a member of the anoctamin family of transmembrane proteins. The encoded protein is likely a calcium activated chloride channel. Mutations in this gene have been associated with gnathodiaphyseal dysplasia. Alternatively spliced transcript variants have been described. [provided by RefSeq, November 2009]. Transcript Variant: This variant (2) lacks an alternate in-frame segment, compared to variant 1, resulting in a shorter protein (isoform b), compared to isoform a. |
| ANUBL1 | 28 | Exonic | N/A | N/A | N/A |
| ANXA6 | 29 | Exonic | 309 | annexin A6 isoform 2 | Annexin VI belongs to a family of calcium-dependent membrane and phospholipid binding proteins. Several members of the annexin family have been implicated in membrane-related events along exocytotic and endocytotic pathways. The annexin VI gene is approximately 60 kbp long and contains 26 |

TABLE 3-continued

| GENE NAME | CNV Gene ID # | Gene Region | NCBI Gene ID | Gene Description | RefSeq Summmary |
|---|---|---|---|---|---|
| | | | | | exons. It encodes a protein of about 68 kDa that consists of eight 68-amino acid repeats separated by linking sequences of variable lengths. It is highly similar to human annexins I and II sequences, each of which contain four such repeats. Annexin VI has been implicated in mediating the endosome aggregation and vesicle fusion in secreting epithelia during exocytosis. Alternatively spliced transcript variants have been described. [provided by RefSeq, August 2010]. Transcript Variant: This variant (2) differs in the 5' UTR, lacks a portion of the 5' coding region, and initiates translation at a downstream start codon, compared to variant 1. The encoded isoform (2) is shorter than isoform 1. Publication Note: This RefSeq record includes a subset of the publications that are available for this gene. Please see the Gene record to access additional publications. |
| AP3M2 | 30 | Exonic | 10947 | AP-3 complex subunit mu-2 | This gene encodes a subunit of the heterotetrameric adaptor-related protein complex 3 (AP-3), which belongs to the adaptor complexes medium subunits family. The AP-3 complex plays a role in protein trafficking to lysosomes and specialized organelles. Multiple alternatively spliced variants, encoding the same protein, have been identified. [provided by RefSeq, August 2008]. Transcript Variant: This variant (1) represents the longest transcript. Variants 1 and 2 encode the same protein. |
| APBA2 | 31 | Exonic | 321 | amyloid beta A4 precursor protein-binding family A member 2 isoform b | The protein encoded by this gene is a member of the X11 protein family. It is a neuronal adapter protein that interacts with the Alzheimer's disease amyloid precursor protein (APP). It stabilizes APP and inhibits production of proteolytic APP fragments including the A beta peptide that is deposited in the brains of Alzheimer's disease patients. This gene product is believed to be involved in signal transduction processes. It is also regarded as a putative vesicular trafficking protein in the brain that can form a complex with the potential to couple synaptic vesicle exocytosis to neuronal cell adhesion. Multiple transcript variants encoding different isoforms have been found for this gene. [provided by RefSeq, July 2008]. Transcript Variant: This variant (2) lacks an alternate in-frame exon, compared to variant 1, resulting in a shorter protein (isoform b), compared to isoform a. Publication Note: This RefSeq record includes a subset of the publications that are available for this gene. Please see the Gene record to access additional publications. |
| APOBEC3C | 32 | Exonic | 27350 | probable DNA dC->dU-editing enzyme APOBEC-3C | This gene is a member of the cytidine deaminase gene family. It is one of seven related genes or pseudogenes found in a cluster thought to result from gene duplication, on chromosome 22. Members of the cluster encode proteins that are structurally and functionally related to the C to U RNA-editing cytidine deaminase APOBEC1. It is thought that the proteins may be RNA editing enzymes and have roles in growth or cell cycle control. [provided by RefSeq, July 2008]. |
| APOL2 | 33 | Exonic | 23780 | apolipoprotein L2 | This gene is a member of the apolipoprotein L gene family. The encoded protein is found in the cytoplasm, where it may affect the movement of lipids or allow the binding of lipids to organelles. Two transcript variants encoding the same protein have been found for this gene. [provided by RefSeq, July 2008]. Transcript Variant: This variant (beta) differs in the 5' UTR compared to variant alpha. Both variants encode the same protein. |
| ARFGAP2 | 34 | Exonic | 84364 | ADP-ribosylation factor GTPase-activating protein 2 isoform 1 | N/A |

TABLE 3-continued

| GENE NAME | Gene ID # | CNV Gene Region | NCBI Gene ID | Gene Description | RefSeq Summmary |
|---|---|---|---|---|---|
| ARHGAP10 | 35 | Exonic | 79658 | rho GTPase-activating protein 10 | N/A |
| ARHGAP15 | 36 | Exonic | 55843 | rho GTPase-activating protein 15 | RHO GTPases (see ARHA; MIM 165390) regulate diverse biologic processes, and their activity is regulated by RHO GTPase-activating proteins (GAPs), such as ARHGAP15 (Seoh et al., 2003 [PubMed 12650940]). [supplied by OMIM, March 2008]. |
| ARHGAP21 | 37 | Exonic | 57584 | rho GTPase-activating protein 21 | ARHGAP21 functions preferentially as a GTPase-activating protein (GAP) for CDC42 (MIM 116952) and regulates the ARP2/3 complex (MIM 604221) for F-actin dynamics at the Golgi through control of CDC42 activity (Dubois et al., 2005 [PubMed 15793564]). [supplied by OMIM, March 2008]. Sequence Note: The 5'-most in-frame translation start codon is selected for this RefSeq and is well-conserved among mammalian species. An alternative start codon that would reduce the protein length by 1 aa is also present. The use of the downstream start codon is assumed in the literature, including PMIDs: 12056806, 15793564 and 17347647. |
| ARHGDIA | 38 | Exonic | 396 | rho GDP-dissociation inhibitor 1 isoform a | Aplysia Ras-related homologs (ARHs), also called Rho genes, belong to the RAS gene superfamily encoding small guanine nucleotide exchange (GTP/GDP) factors. The ARH proteins may be kept in the inactive, GDP-bound state by interaction with GDP dissociation inhibitors, such as ARHGDIA (Leffers et al., 1993 [PubMed 8262133]). [supplied by OMIM, January 2009]. Transcript Variant: This variant (1) represents the longest transcript and encodes the longer isoform (a). Variants 1 and 2 both encode isoform a. |
| ARHGEF26 | 39 | Exonic | 26084 | Src homology 3 domain-containing guanine nucleotide exchange factor isoform 1 | This gene encodes a member of the Rho-guanine nucleotide exchange factor (Rho-GEF) family. These proteins regulate Rho GTPases by catalyzing the exchange of GDP for GTP. The encoded protein specifically activates RhoG and plays a role in the promotion of macropinocytosis. Underexpression of the encoded protein may be a predictive marker of chemoresistant disease. Alternatively spliced transcript variants encoding multiple isoforms have been observed for this gene. [provided by RefSeq, October 2011]. Transcript Variant: This variant (2) differs in the 5' UTR compared to variant 1. Variants 1 and 2 encode the same isoform (1). Sequence Note: This RefSeq record was created from transcript and genomic sequence data because no single transcript was available for the full length of the gene. The extent of this transcript is supported by transcript alignments. |
| ARL16 | 40 | Exonic | 339231 | ADP-ribosylation factor-like protein 16 | N/A |
| ARMC5 | 41 | Exonic | 79798 | armadillo repeat-containing protein 5 isoform a precursor | N/A |
| ARMCX4 | 42 | Exonic | 100131755 | N/A | N/A |
| ASPSCR1 | 43 | Exonic | 79058 | N/A | The protein encoded by this gene contains a UBX domain and interacts with glucose transporter type 4 (GLUT4). This protein is a tether, which sequesters the GLUT4 in intracellular vesicles in muscle and fat cells in the absence of insulin, and redistributes the GLUT4 to the plasma membrane within minutes of insulin stimulation. Translocation t(X; 17)(p11; q25) of this gene with transcription factor TFE3 gene results in a ASPSCR1-TFE3 fusion protein in |

TABLE 3-continued

| GENE NAME | Gene ID # | CNV Gene Region | NCBI Gene ID | Gene Description | RefSeq Summmary |
|---|---|---|---|---|---|
| | | | | | alveolar soft part sarcoma and in renal cell carcinomas. Multiple alternatively spliced transcript variants have been found. [provided by RefSeq, October 2011]. Transcript Variant: This variant (3) lacks an internal exon in the 5' region, which results in a frame-shift and premature translation termination, compared to variant 1. The resulting transcript is a nonsense-mediated mRNA decay candidate. |
| ASTN2 | 44 | Exonic | 23245 | astrotactin-2 isoform f | This gene encodes a protein that is expressed in the brain and may function in neuronal migration, based on functional studies of the related astrotactin 1 gene in human and mouse. A deletion at this locus has been associated with schizophrenia. Multiple transcript variants encoding different proteins have been found for this locus. [provided by RefSeq, May 2010]. Transcript Variant: This variant (6) has multiple differences compared to variant 1. These differences result in a distinct 5' UTR and lead to translation initiation at an alternate start codon, compared to variant 1. The encoded isoform (f) has distinct N- and C-termini and is shorter than isoform a. |
| ATAD5 | 45 | Exonic | 79915 | ATPase family AAA domain-containing protein 5 | N/A |
| ATRNL1 | 46 | Exonic | 26033 | attractin-like protein 1 precursor | N/A |
| BAHCC1 | 47 | Exonic | 57597 | BAH and coiled-coil domain-containing protein 1 | N/A |
| BASP1P1 | 48 | Exonic | 646201 | N/A | N/A |
| BCAP29 | 49 | Exonic | 55973 | B-cell receptor-associated protein 29 isoform a | N/A |
| BCAS1 | 50 | Exonic | 8537 | breast carcinoma-amplified sequence 1 | This gene resides in a region at 20q13 which is amplified in a variety of tumor types and associated with more aggressive tumor phenotypes. Among the genes identified from this region, it was found to be highly expressed in three amplified breast cancer cell lines and in one breast tumor without amplification at 20q13.2. However, this gene is not in the common region of maximal amplification and its expression was not detected in the breast cancer cell line MCF7, in which this region is highly amplified. Although not consistently expressed, this gene is a candidate oncogene. [provided by RefSeq, July 2008]. Sequence Note: The RefSeq transcript and protein were derived from genomic sequence to make the sequence consistent with the reference genome assembly. The genomic coordinates used for the transcript record were based on alignments. |
| BID | 51 | Exonic | 637 | BH3-interacting domain death agonist isoform 3 | This gene encodes a death agonist that heterodimerizes with either agonist BAX or antagonist BCL2. The encoded protein is a member of the BCL-2 family of cell death regulators. It is a mediator of mitochondrial damage induced by caspase-8 (CASP8); CASP8 cleaves this encoded protein, and the COOH-terminal part translocates to mitochondria where it triggers cytochrome c release. Multiple alternatively spliced transcript variants have been found, but the full-length nature of some variants has not been defined. [provided by RefSeq, July 2008]. Transcript Variant: This variant (7) lacks two alternate coding exons compared to variant 1, that causes a frameshift. This variant uses a |

TABLE 3-continued

| GENE NAME | Gene ID # | CNV Gene Region | NCBI Gene ID | Gene Description | RefSeq Summmary |
|---|---|---|---|---|---|
| BMX | 52 | Exonic | 660 | cytoplasmic tyrosine-protein kinase BMX | downstream in-frame start-codon, so the encoded isoform 3 has a shorter N-terminus, as compared to isoform 1. This gene encodes a non-receptor tyrosine kinase belonging to the Tec kinase family. The protein contains a PH-like domain, which mediates membrane targeting by binding to phosphatidylinositol 3,4,5-triphosphate (PIP3), and a SH2 domain that binds to tyrosine-phosphorylated proteins and functions in signal transduction. The protein is implicated in several signal transduction pathways including the Stat pathway, and regulates differentiation and tumorigenicity of several types of cancer cells. Multiple alternatively spliced variants, encoding the same protein, have been identified. [provided by RefSeq, September 2009]. Transcript Variant: This variant (2) has an alternate 5' UTR exon, as compared to variant 1. Both variants 1 and 2 encode the same protein. |
| BRD7 | 53 | Exonic | 29117 | bromodomain-containing protein 7 isoform 1 | This gene encodes a protein which is a member of the bromodomain-containing protein family. The product of this gene has been identified as a component of one form of the SWI/SNF chromatin remodeling complex, and as a protein which interacts with p53 and is required for p53-dependent oncogene-induced senescence which prevents tumor growth. Pseudogenes have been described on chromosomes 2, 3, 6, 13 and 14. Alternative splicing results in multiple transcript variants. [provided by RefSeq, July 2010]. Transcript Variant: This variant (1) represents the longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. |
| BTG4 | 54 | Exonic | 54766 | protein BTG4 | The protein encoded by this gene is a member of the BTG/Tob family. This family has structurally related proteins that appear to have antiproliferative properties. This encoded protein can induce G1 arrest in the cell cycle. [provided by RefSeq, July 2008]. Sequence Note: This RefSeq record was created from transcript and genomic sequence data to make the sequence consistent with the reference genome assembly. The genomic coordinates used for the transcript record were based on transcript alignments. |
| BTN2A1 | 55 | Exonic | 11120 | butyrophilin subfamily 2 member A1 isoform 4 precursor | This gene is a member of the BTN2 subfamily of genes, which encode proteins belonging to the butyrophilin protein family. The gene is located in a cluster on chromosome 6, consisting of seven genes belonging to the expanding B7/butyrophilin-like group, a subset of the immunoglobulin gene superfamily. The encoded protein is an integral plasma membrane B box protein involved in lipid, fatty-acid and sterol metabolism. Multiple alternatively spliced transcript variants encoding different isoforms have been found for this gene. [provided by RefSeq, October 2010]. Transcript Variant: This variant (4) has an alternate 3' exon compared to variant 1. The encoded isoform (4) is shorter and has a unique C-terminus compared to isoform 1. |
| BTN3A3 | 56 | Exonic | 10384 | butyrophilin subfamily 3 member A3 isoform c | The butyrophilin (BTN) genes are a group of major histocompatibility complex (MHC)-associated genes that encode type I membrane proteins with 2 extracellular immunoglobulin (Ig) domains and an intracellular B30.2 (PRYSPRY) domain. Three subfamilies of human BTN genes are located in the MHC class I region: the single-copy BTN1A1 gene (MIM 601610) and the BTN2 (e.g., BTN2A1; MIM 613590) and BTN3 (e.g., BNT3A3) genes, which have undergone tandem duplication, resulting in 3 copies of each (summary by Smith et al., 2010 [PubMed 20208008]). [supplied by OMIM, November 2010]. |

TABLE 3-continued

| GENE NAME | Gene ID # | CNV Gene Region | NCBI Gene ID | Gene Description | RefSeq Summmary |
|---|---|---|---|---|---|
| BTNL3 | 57 | Exonic | 10917 | butyrophilin-like protein 3 precursor | Transcript Variant: This variant (3) lacks several exons in two regions, but the open reading frame is retained, compared to variant 1. The encoded isoform (c) has a shorter N-terminus and lacks an internal segment, compared to isoform a. |
| C11orf49 | 58 | Exonic | 79096 | UPF0705 protein C11orf49 isoform 4 | N/A |
| C11orf96 | 59 | Exonic | 387763 | uncharacterized protein C11orf96 | N/A |
| C12orf47 | 60 | Exonic | 51275 | N/A | N/A |
| C13orf38 | 61 | Exonic | N/A | N/A | N/A |
| C13orf38-SOHLH2 | 62 | Exonic | N/A | N/A | N/A |
| C14orf166 | 63 | Exonic | 51637 | UPF0568 protein C14orf166 | N/A |
| C16orf89 | 64 | Exonic | 146556 | UPF0764 protein C16orf89 isoform 1 precursor | This gene is expressed predominantly in the thyroid. Based on expression patterns similar to thyroid transcription factors and proteins, this gene may function in the development and function of the thyroid. Multiple transcript variants encoding different isoforms have been found for this gene. [provided by RefSeq, October 2011]. Transcript Variant: This variant (1) encodes the longer isoform (1). |
| C17orf70 | 65 | Exonic | 80233 | Fanconi anemia-associated protein of 100 kDa isoform b | FAAP100 is a component of the Fanconi anemia (FA; MIM 277650) core complex and is required for core complex stability and FANCD2 (see MIM 227646) monoubiquitination (Ling et al., 2007 [PubMed 17396147]). [supplied by OMIM, March 2008]. Transcript Variant: This variant (2) represents the shorter transcript and encodes the functional protein. Sequence Note: This RefSeq record was created from transcript and genomic sequence data to make the sequence consistent with the reference genome assembly. The genomic coordinates used for the transcript record were based on transcript alignments. |
| C17orf90 | 66 | Exonic | 339229 | uncharacterized protein C17orf90 | N/A |
| C18orf16 | 67 | Exonic | N/A | N/A | N/A |
| C1orf106 | 68 | Exonic | 55765 | uncharacterized protein C1orf106 isoform 2 | N/A |
| C1orf144 | 69 | Exonic | 26099 | UPF0485 protein C1orf144 isoform 1 | N/A |
| C2orf15 | 70 | Exonic | 150590 | uncharacterized protein C2orf15 | N/A |
| C2orf48 | 71 | Exonic | 348738 | uncharacterized protein C2orf48 | N/A |
| C3orf43 | 72 | Exonic | 255798 | uncharacterized protein C3orf43 | N/A |
| C4orf37 | 73 | Exonic | 285555 | uncharacterized protein C4orf37 | N/A |
| C6orf126 | 74 | Exonic | 389383 | colipase-like protein C6orf126 precursor | N/A |
| C6orf127 | 75 | Exonic | 340204 | colipase-like | N/A |

TABLE 3-continued

| GENE NAME | Gene ID # | CNV Gene Region | NCBI Gene ID | Gene Description | RefSeq Summmary |
|---|---|---|---|---|---|
| C6orf99 | 76 | Exonic | 100130967 | putative uncharacterized protein C6orf127 precursor | N/A |
| C7orf63 | 77 | Exonic | 79846 | uncharacterized protein C7orf63 isoform 1 | N/A |
| C9orf85 | 78 | Exonic | 138241 | uncharacterized protein C9orf85 | N/A |
| C9orf93 | 79 | Exonic | 203238 | uncharacterized protein C9orf93 | N/A |
| CACNA2D3 | 80 | Exonic | 55799 | voltage-dependent calcium channel subunit alpha-2/delta-3 precursor | This gene encodes a member of the alpha-2/delta subunit family, a protein in the voltage-dependent calcium channel complex. Calcium channels mediate the influx of calcium ions into the cell upon membrane polarization and consist of a complex of alpha-1, alpha-2/delta, beta, and gamma subunits in a 1:1:1:1 ratio. Various versions of each of these subunits exist, either expressed from similar genes or the result of alternative splicing. Research on a highly similar protein in rabbit suggests the protein described in this record is cleaved into alpha-2 and delta subunits. Alternate transcriptional splice variants of this gene have been observed but have not been thoroughly characterized. [provided by RefSeq, July 2008]. |
| CACNG8 | 81 | Exonic | 59283 | voltage-dependent calcium channel gamma-8 subunit | The protein encoded by this gene is a type I transmembrane AMPA receptor regulatory protein (TARP). TARPs regulate both trafficking and channel gating of the AMPA receptors. This gene is part of a functionally diverse eight-member protein subfamily of the PMP-22/EMP/MP20 family and is located in a cluster with two family members, a type II TARP and a calcium channel gamma subunit. The mRNA for this gene is believed to initiate translation from a non-AUG (CUG) start codon. [provided by RefSeq, December 2010]. Sequence Note: This RefSeq record was created from transcript and genomic sequence data to make the sequence consistent with the reference genome assembly. The genomic coordinates used for the transcript record were based on transcript alignments. |
| CADPS2 | 82 | Exonic | 93664 | calcium-dependent secretion activator 2 isoform c | This gene encodes a member of the calcium-dependent activator of secretion (CAPS) protein family, which are calcium binding proteins that regulate the exocytosis of synaptic and dense-core vesicles in neurons and neuroendocrine cells. Mutations in this gene may contribute to autism susceptibility. Multiple transcript variants encoding different isoforms have been found for this gene. [provided by RefSeq, November 2009]. Transcript Variant: This variant (3) resents rep- the longest transcript and encodes the longest isoform (c). Sequence Note: This RefSeq record was created from transcript and genomic sequence data to make the sequence consistent with the reference genome assembly. The genomic coordinates used for the transcript record were based on transcript alignments. |
| CAMSAP1L1 | 83 | Exonic | N/A | N/A | N/A |
| CAPN14 | 84 | Exonic | 440854 | calpain-14 | Calpains are a family of cytosolic calcium-activated cysteine proteases involved in a variety of cellular processes including apoptosis, cell division, modulation of integrin-cytoskeletal interactions, and synaptic plasticity (Dear et al., 2000 [PubMed 10964513]). CAPN14 belongs to the calpain large subunit family. [supplied by OMIM, March 2008]. |

TABLE 3-continued

| GENE NAME | Gene ID # | CNV Gene Region | NCBI Gene ID | Gene Description | RefSeq Summmary |
|---|---|---|---|---|---|
| CASC4 | 85 | Exonic | 113201 | protein CASC4 isoform b | The increased expression level of this gene is associated with HER-2/neu proto-oncogene overexpression. Amplification and resulting overexpression of this proto-oncogene are found in approximately 30% of human breast and 20% of human ovarian cancers. Alternatively spliced variants encoding different isoforms have been identified for this gene. [provided by RefSeq, December 2010]. Transcript Variant: This variant (2) lacks an in-frame segment of the coding region, compared to variant 1. It encodes a shorter isoform (b), that is missing an internal segment compared to isoform a. |
| CASP10 | 86 | Exonic | 843 | caspase-10 isoform 6 preproprotein | This gene encodes a protein which is a member of the cysteine-aspartic acid protease (caspase) family. Sequential activation of caspases plays a central role in the execution-phase of cell apoptosis. Caspases exist as inactive proenzymes which undergo proteolytic processing at conserved aspartic residues to produce two subunits, large and small, that dimerize to form the active enzyme. This protein cleaves and activates caspases 3 and 7, and the protein itself is processed by caspase 8. Mutations in this gene are associated with type IIA autoimmune lymphoproliferative syndrome, non-Hodgkin lymphoma and gastric cancer. Alternatively spliced transcript variants encoding different isoforms have been described for this gene. [provided by RefSeq, April 2011]. Transcript Variant: This variant (6) lacks two in-frame coding exons compared to variant 1. This results in a shorter isoform (6) missing an internal protein segment compared to isoform 1. Sequence Note: This RefSeq record was created from transcript and genomic sequence data to make the sequence consistent with the reference genome assembly. The genomic coordinates used for the transcript record were based on transcript alignments. |
| CCDC137 | 87 | Exonic | 339230 | coiled-coil domain-containing protein 137 | N/A |
| CCDC18 | 88 | Exonic | 343099 | coiled-coil domain-containing protein 18 | N/A |
| CCDC57 | 89 | Exonic | 284001 | coiled-coil domain-containing protein 57 | N/A |
| CCM2 | 90 | Exonic | 83605 | malcavernin isoform 4 | This gene encodes a scaffold protein that functions in the stress-activated p38 Mitogen-activated protein kinase (MAPK) signaling cascade. The protein interacts with SMAD specific E3 ubiquitin protein ligase 1 (also known as SMURF1) via a phosphotyrosine binding domain to promote RhoA degradation. The protein is required for normal cytoskeletal structure, cell-cell interactions, and lumen formation in endothelial cells. Mutations in this gene result in cerebral cavernous malformations. Multiple transcript variants encoding different isoforms have been found for this gene. [provided by RefSeq, November 2009]. Transcript Variant: This variant (4) represents use of an alternate promoter and 5' UTR, uses a distinct start codon, and lacks two alternate in-frame exons in the central coding region, compared to variant 1. The resulting isoform (4) has a shorter and distinct N-terminus and lacks an internal segment, compared to isoform 1. Publication Note: This RefSeq record includes a subset of the publications that are available for this gene. Please see the Gene record to access additional publications. |

TABLE 3-continued

| GENE NAME | Gene ID # | CNV Gene Region | NCBI Gene ID | Gene Description | RefSeq Summmary |
|---|---|---|---|---|---|
| CD109 | 91 | Exonic | 135228 | CD109 antigen isoform 3 precursor | This gene encodes a member of the alpha2-macroglobulin/complement superfamily. The encoded GPI-linked glycoprotein is found on the cell surface of platelets, activated T-cells, and endothelial cells. The protein binds to and negatively regulates signaling of transforming growth factor beta (TGF-beta). Multiple transcript variants encoding different isoforms have been found for this gene. [provided by RefSeq, April 2009]. Transcript Variant: This variant (3) lacks an alternate in-frame exon in the 5' coding region, compared to variant 1. The resulting isoform (3) lacks an internal 77-aa segment near the N-terminus, compared to isoform 1. |
| CD46 | 92 | Exonic | 4179 | membrane cofactor protein isoform 14 precursor | The protein encoded by this gene is a type I membrane protein and is a regulatory part of the complement system. The encoded protein has cofactor activity for inactivation of complement components C3b and C4b by serum factor I, which protects the host cell from damage by complement. In addition, the encoded protein can act as a receptor for the Edmonston strain of measles virus, human herpesvirus-6, and type IV pili of pathogenic Neisseria. Finally, the protein encoded by this gene may be involved in the fusion of the spermatozoa with the oocyte during fertilization. Mutations at this locus have been associated with susceptibility to hemolytic uremic syndrome. Alternatively spliced transcript variants encoding different isoforms have been described. [provided by RefSeq, June 2010]. Transcript Variant: This variant (n) lacks three alternate in-frame exons as well as an alternate segment compared to variant a, which causes a frameshift. The resulting isoform (14) is shorter and has a distinct C-terminus compared to isoform 1. |
| CDH13 | 93 | Exonic | 1012 | cadherin-13 isoform 6 precursor | This gene encodes a member of the cadherin superfamily. The encoded protein is localized to the surface of the cell membrane and is anchored by a GPI moiety, rather than by a transmembrane domain. The protein lacks the cytoplasmic domain characteristic of other cadherins, and so is not thought to be a cell-cell adhesion glycoprotein. This protein acts as a negative regulator of axon growth during neural differentiation. It also protects vascular endothelial cells from apoptosis due to oxidative stress, and is associated with resistance to atherosclerosis. The gene is hypermethylated in many types of cancer. Alternative splicing results in multiple transcript variants encoding different isoforms. [provided by RefSeq, May 2011]. Transcript Variant: This variant (6) lacks several coding exons and includes two alternate exons at the 3' end, compared to variant 1. It encodes isoform 6, which is shorter and has a distinct C-terminus, compared to isoform 1. |
| CECR2 | 94 | Exonic | 27443 | cat eye syndrome critical region protein 2 | N/A |
| CEL | 95 | Exonic | 1056 | bile salt-activated lipase precursor | The protein encoded by this gene is a glycoprotein secreted from the pancreas into the digestive tract and from the lactating mammary gland into human milk. The physiological role of this protein is in cholesterol and lipid-soluble vitamin ester hydrolysis and absorption. This encoded protein promotes large chylomicron production in the intestine. Also its presence in plasma suggests its interactions with cholesterol and oxidized lipoproteins to modulate the progression of atherosclerosis. In pancreatic tumoral cells, this encoded protein is thought to be sequestrated within the Golgi compartment and is probably not secreted. This gene contains a variable number of tandem repeat (VNTR) |

TABLE 3-continued

| GENE NAME | Gene ID # | CNV Gene Region | NCBI Gene ID | Gene Description | RefSeq Summmary |
|---|---|---|---|---|---|
| CELSR3 | 96 | Exonic | 1951 | cadherin EGF LAG seven-pass G-type receptor 3 precursor | polymorphism in the coding region that may influence the function of the encoded protein. [provided by RefSeq, July 2008]. The protein encoded by this gene is a member of the flamingo subfamily, part of the cadherin superfamily. The flamingo subfamily consists of nonclassic-type cadherins; a subpopulation that does not interact with catenins. The flamingo cadherins are located at the plasma membrane and have nine cadherin domains, seven epidermal growth factor-like repeats and two laminin A G-type repeats in their ectodomain. They also have seven transmembrane domains, a characteristic unique to this subfamily. It is postulated that these proteins are receptors involved in contact-mediated communication, with cadherin domains acting as homophilic binding regions and the EGF-like domains involved in cell adhesion and receptor-ligand interactions. The specific function of this particular member has not been determined. [provided by RefSeq, July 2008]. |
| CEP57 | 97 | Exonic | 9702 | centrosomal protein of 57 kDa isoform a | This gene encodes a cytoplasmic protein called Translokin. This protein localizes to the centrosome and has a function in microtubular stabilization. The N-terminal half of this protein is required for its centrosome localization and for its multimerization, and the C-terminal half is required for nucleating, bundling and anchoring microtubules to the centrosomes. This protein specifically interacts with fibroblast growth factor 2 (FGF2), sorting nexin 6, Ran-binding protein M and the kinesins KIF3A and KIF3B, and thus mediates the nuclear translocation and mitogenic activity of the FGF2. It also interacts with cyclin D1 and controls nucleocytoplasmic distribution of the cyclin D1 in quiescent cells. This protein is crucial for maintaining correct chromosomal number during cell division. Mutations in this gene cause mosaic variegated aneuploidy syndrome, a rare autosomal recessive disorder. Multiple alternatively spliced transcript variants encoding different isoforms have been identified. [provided by RefSeq, August 2011]. Transcript Variant: This variant (1) encodes the longest isoform (a). |
| CETN2 | 98 | Exonic | 1069 | centrin-2 | Caltractin belongs to a family of calcium-binding proteins and is a structural component of the centrosome. The high level of conservation from algae to humans and its association with the centrosome suggested that caltractin plays a fundamental role in the structure and function of the microtubule-organizing center, possibly required for the proper duplication and segregation of the centrosome. [provided by RefSeq, July 2008]. |
| CETN3 | 99 | Exonic | 1070 | centrin-3 | The protein encoded by this gene contains four EF-hand calcium binding domains, and is a member of the centrin protein family. Centrins are evolutionarily conserved proteins similar to the CDC31 protein of S. cerevisiae. Yeast CDC31 is located at the centrosome of interphase and mitotic cells, where it plays a fundamental role in centrosome duplication and separation. Multiple forms of the proteins similar to the yeast centrin have been identified in human and other mammalian cells, some of which have been shown to be associated with centrosome fractions. This protein appears to be one of the most abundant centrins associated with centrosome, which suggests a similar function to its yeast counterpart. [provided by RefSeq, July 2008]. Publication Note: This RefSeq record includes a subset of the publications that are available for this gene. Please see the Gene record to access additional publications. |
| CFLAR | 100 | Exonic | 8837 | CASP8 and FADD-like apoptosis regulator isoform 6 | The protein encoded by this gene is a regulator of apoptosis and is structurally similar to caspase-8. However, the encoded protein lacks caspase activity and appears to be itself cleaved into two peptides by caspase-8. Several transcript variants encoding different isoforms have been found for this gene, and partial |

TABLE 3-continued

| GENE NAME | Gene ID # | CNV Gene Region | NCBI Gene ID | Gene Description | RefSeq Summmary |
|---|---|---|---|---|---|
| | | | | | evidence for several more variants exists. [provided by RefSeq, February 2011]. Transcript Variant: This variant (7) differs in the 5' UTR and coding sequence and the 3' UTR and coding sequence compared to variant 1. The resulting isoform (6) is shorter at the N-terminus and has a shorter and distinct C-terminus compared to isoform 1. Variants 7 and 8 both encode isoform 6. Sequence Note: This RefSeq record was created from transcript and genomic sequence data to make the sequence consistent with the reference genome assembly. The genomic coordinates used for the transcript record were based on transcript alignments. |
| CHL1 | 101 | Exonic | 10752 | neural cell adhesion molecule L1-like protein precursor | The protein encoded by this gene is a member of the L1 gene family of neural cell adhesion molecules. It is a neural recognition molecule that may be involved in signal transduction pathways. The deletion of one copy of this gene may be responsible for mental defects in patients with 3p-syndrome. Several alternatively spliced transcript variants of this gene have been described, but their full length nature is not known. [provided by RefSeq, July 2008]. |
| CLEC4A | 102 | Exonic | 50856 | C-type lectin domain family 4 member A isoform 2 | This gene encodes a member of the C-type lectin/C-type lectin-like domain (CTL/CTLD) superfamily. Members of this family share a common protein fold and have diverse functions, such as cell adhesion, cell-cell signalling, glycoprotein turnover, and roles in inflammation and immune response. The encoded type 2 transmembrane protein may play a role in inflammatory and immune response. Multiple transcript variants encoding distinct isoforms have been identified for this gene. This gene is closely linked to other CTL/CTLD superfamily members on chromosome 12p13 in the natural killer gene complex region. [provided by RefSeq, July 2008]. Transcript Variant: This variant (2), also known as C-type lectin DDB27 short form, lacks an in-frame segment of the coding region, compared to variant 1. It encodes a shorter isoform (2), that is missing the transmembrane domain compared to isoform 1. |
| CLECL1 | 103 | Exonic | 160365 | C-type lectin-like domain family 1 | DCAL1 is a type II transmembrane, C-type lectin-like protein expressed on dendritic cells (DCs) and B cells. It interacts with subsets of T cells as a costimulatory molecule that enhances interleukin-4 (IL4; MIM 147780) production. [supplied by OMIM, April 2004]. |
| CLOCK | 104 | Exonic | 9575 | circadian locomoter output cycles protein kaput | This gene encodes a protein that belongs to the basic helix-loop-helix (bHLH) family of transcription factors. Polymorphisms within the encoded protein have been associated with circadian rhythm sleep disorders. A similar protein in mice is a circadian regulator that acts as a transcription factor and forms a heterodimer with aryl hydrocarbon receptor nuclear translocator-like to activate transcription of mouse period 1. [provided by RefSeq, May 2011]. |
| CNTLN | 105 | Exonic | 54875 | centlein isoform 2 | N/A |
| CNTN4 | 106 | Exonic | 152330 | contactin-4 isoform a precursor | This gene encodes a member of the contactin family of immunoglobulins. Contactins are axon-associated cell adhesion molecules that function in neuronal network formation and plasticity. The encoded protein is a glycosylphosphatidylinositol-anchored neuronal membrane protein that may play a role in the formation of axon connections in the developing nervous system. Deletion or mutation of this gene may play a role in 3p deletion syndrome and autism spectrum disorders. Alternative splicing results in multiple transcript variants. [provided by RefSeq, May 2011]. Transcript Variant: This variant (1) encodes the longest isoform (a). Both variants 1 and 4 encode the same isoform. |

TABLE 3-continued

| GENE NAME | CNV Gene ID # | CNV Gene Region | NCBI Gene ID | Gene Description | RefSeq Summmary |
|---|---|---|---|---|---|
| CNTN5 | 107 | Exonic | 53942 | contactin-5 isoform 1 precursor | The protein encoded by this gene is a member of the immunoglobulin superfamily, and contactin family, which mediate cell surface interactions during nervous system development. This protein is a glycosylphosphatidylinositol (GPI)-anchored neuronal membrane protein that functions as a cell adhesion molecule. It may play a role in the formation of axon connections in the developing nervous system. Alternatively spliced transcript variants encoding different isoforms have been described for this gene. [provided by RefSeq, August 2011]. Transcript Variant: This variant (2) lacks an exon in the 5' non-coding region, thus has a shorter 5' UTR compared to variant 1. Variants 1 and 2 encode the same isoform (1). Sequence Note: This RefSeq record was created from transcript and genomic sequence data to make the sequence consistent with the reference genome assembly. The genomic coordinates used for the transcript record were based on transcript alignments. |
| CNTNAP2 | 108 | Both | 26047 | contactin-associated protein-like 2 precursor | This gene encodes a member of the neurexin family which functions in the vertebrate nervous system as cell adhesion molecules and receptors. This protein, like other neurexin proteins, contains epidermal growth factor repeats and laminin G domains. In addition, it includes an F5/8 type C domain, discoidin/neuropilin- and fibrinogen-like domains, thrombospondin N-terminal-like domains and a putative PDZ binding site. This protein is localized at the juxtaparanodes of myelinated axons, and mediates interactions between neurons and glia during nervous system development and is also involved in localization of potassium channels within differentiating axons. This gene encompasses almost 1.5% of chromosome 7 and is one of the largest genes in the human genome. It is directly bound and regulated by forkhead box protein P2 (FOXP2), a transcription factor related to speech and language development. This gene has been implicated in multiple neurodevelopmental disorders, including Gilles de la Tourette syndrome, schizophrenia, epilepsy, autism, ADHD and mental retardation. [provided by RefSeq, March 2010]. Sequence Note: This RefSeq record was created from transcript and genomic sequence data to make the sequence consistent with the reference genome assembly. The genomic coordinates used for the transcript record were based on transcript alignments. |
| CNTNAP5 | 109 | Exonic | 129684 | contactin-associated protein-like 5 precursor | This gene product belongs to the neurexin family, members of which function in the vertebrate nervous system as cell adhesion molecules and receptors. This protein, like other neurexin proteins, contains epidermal growth factor repeats and laminin G domains. In addition, it includes an F5/8 type C domain, discoidin/neuropilin- and fibrinogen-like domains, and thrombospondin N-terminal-like domains. [provided by RefSeq, July 2008]. |
| COL24A1 | 110 | Exonic | 255631 | collagen alpha-1(XXIV) chain precursor | N/A |
| COL27A1 | 111 | Exonic | 85301 | collagen alpha-1(XXVII) chain preproprotein | Fibrillar collagens, such as COL27A1, compose one of the most ancient families of extracellular matrix molecules. They form major structural elements in extracellular matrices of cartilage, skin, and tendon (Boot-Handford et al., 2003 [PubMed 12766169]). [supplied by OMIM, March 2008]. |
| COL7A1 | 112 | Exonic | 1294 | collagen alpha-1(VII) chain precursor | This gene encodes the alpha chain of type VII collagen. The type VII collagen fibril, composed of three identical alpha collagen chains, is restricted to the basement zone beneath stratified squamous epithelia. It functions as an anchoring fibril between the external epithelia and the underlying stroma. Mutations in this gene are associated with all forms of dystrophic epidermolysis |

TABLE 3-continued

| GENE NAME | Gene ID # | CNV Gene Region | NCBI Gene ID | Gene Description | RefSeq Summmary |
|---|---|---|---|---|---|
| | | | | | bullosa. In the absence of mutations, however, an acquired form of this disease can result from an autoimmune response made to type VII collagen. [provided by RefSeq, July 2008]. Publication Note: This RefSeq record includes a subset of the publications that are available for this gene. Please see the Gene record to access additional publications. |
| COMMD7 | 113 | Exonic | 149951 | COMM domain-containing protein 7 isoform 2 | N/A |
| CORN | 114 | Exonic | 10699 | atrial natriuretic peptide-converting enzyme | This gene encodes a member of the type II transmembrane serine protease class of the trypsin superfamily. Members of this family are composed of multiple structurally distinct domains. The encoded protein converts pro-atrial natriuretic peptide to biologically active atrial natriuretic peptide, a cardiac hormone that regulates blood volume and pressure. This protein may also function as a pro-brain-type natriuretic peptide convertase. [provided by RefSeq, July 2008]. |
| COX18 | 115 | Exonic | 285521 | mitochondrial inner membrane protein COX18 precursor | COX18 encodes a cytochrome c oxidase (COX)-assembly protein. The S. cerevisiae Cox18 protein catalyzes the insertion of the Cox2 (MTCO2; MIM 516040) C-terminal tail into the mitochondrial inner membrane, an intermediate step in the assembly of complex IV of the mitochondrial respiratory chain (Sacconi et al., 2005 [PubMed 16212937]). [supplied by OMIM, March 2008]. |
| CPNE9 | 116 | Exonic | 151835 | copine-9 | N/A |
| CREBBP | 117 | Exonic | 1387 | CREB-binding protein isoform b | This gene is ubiquitously expressed and is involved in the transcriptional coactivation of many different transcription factors. First isolated as a nuclear protein that binds to cAMP-response element binding protein (CREB), this gene is now known to play critical roles in embryonic development, growth control, and homeostasis by coupling chromatin remodeling to transcription factor recognition. The protein encoded by this gene has intrinsic histone acetyltransferase activity and also acts as a scaffold to stabilize additional protein interactions with the transcription complex. This protein acetylates both histone and non-histone proteins. This protein shares regions of very high sequence similarity with protein p300 in its bromodomain, cysteine-histidine-rich regions, and histone acetyltransferase domain. Mutations in this gene cause Rubinstein-Taybi syndrome (RTS). Chromosomal translocations involving this gene have been associated with acute myeloid leukemia. Alternative splicing results in multiple transcript variants encoding different isoforms. [provided by RefSeq, February 2009]. Transcript Variant: This variant (2) lacks an alternate in-frame exon in the 5' coding region, compared to variant 1, resulting in a shorter protein (isoform b), compared to isoform a. |
| CSDAP1 | 118 | Exonic | 440359 | N/A | N/A |
| CSGALNACT2 | 119 | Exonic | 55454 | chondroitin sulfate N-acetylgalactosaminyl-transferase 2 | N/A |
| CSNK1D | 120 | Exonic | 1453 | casein kinase I isoform delta isoform 2 | This gene is a member of the casein kinase I (CKI) gene family whose members have been implicated in the control of cytoplasmic and nuclear processes, including DNA replication and repair. The encoded protein is highly similar to the mouse and rat CK1 delta homologs. Two transcript variants encoding different isoforms have been found for this gene. [provided by RefSeq, July 2008]. Transcript Variant: This variant (2) has an additional exon at the 3' end compared to transcript variant 1. This results in a shorter isoform (2) with a |

TABLE 3-continued

| GENE NAME | CNV Gene ID # | CNV Gene Region | NCBI Gene ID | Gene Description | RefSeq Summmary |
|---|---|---|---|---|---|
| | | | | | different C-terminus compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| CTDSP1 | 121 | Exonic | 58190 | carboxy-terminal domain RNA polymerase II polypeptide A small phosphatase 1 isoform 3 | This gene encodes a member of the small C-terminal domain phosphatase (SCP) family of nuclear phosphatases. These proteins play a role in transcriptional regulation through specific dephosphorylation of phosphoserine 5 within tandem heptapeptide repeats of the C-terminal domain of RNA polymerase II. The encoded protein plays a role in neuronal gene silencing in non-neuronal cells, and may also inhibit osteoblast differentiation. Alternatively spliced transcript variants encoding multiple isoforms have been observed for this gene. [provided by RefSeq, October 2011]. Transcript Variant: This variant (3) differs in the 5' UTR and has multiple differences in the coding region, including the use of an alternate start codon, compared to variant 1. The encoded isoform (3) is shorter and has a distinct N-terminus, compared to isoform 1. Sequence Note: This RefSeq record was created from transcript and genomic sequence data to make the sequence consistent with the reference genome assembly. The genomic coordinates used for the transcript record were based on transcript alignments. |
| CTNNA3 | 122 | Exonic | 29119 | catenin alpha-3 | N/A |
| CTSL2 | 123 | Exonic | 1515 | cathepsin L2 preproprotein | The protein encoded by this gene, a member of the peptidase C1 family, is a lysosomal cysteine proteinase that may play an important role in corneal physiology. This gene is expressed in colorectal and breast carcinomas but not in normal colon, mammary gland, or peritumoral tissues, suggesting a possible role for this gene in tumor processes. Alternatively spliced variants, encoding the same protein, have been identified. [provided by RefSeq, January 2011]. Transcript Variant: This variant (2) differs in the 5' UTR compared to variant 1. Both variants 1 and 2 encode the same protein. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| CUTA | 124 | Exonic | 51596 | protein CutA isoform 3 precursor | N/A |
| CXorf57 | 125 | Exonic | 55086 | uncharacterized protein CXorf57 isoform 2 | N/A |
| CYB5R1 | 126 | Exonic | 51706 | NADH-cytochrome b5 reductase 1 | N/A |
| CYP1A1 | 127 | Exonic | 1543 | cytochrome P450 1A1 | This gene, CYP1A1, encodes a member of the cytochrome P450 superfamily of enzymes. The cytochrome P450 proteins are monooxygenases which catalyze many reactions involved in drug metabolism and synthesis of cholesterol, steroids and other lipids. This protein localizes to the endoplasmic reticulum and its expression is induced by some polycyclic aromatic hydrocarbons (PAHs), |

TABLE 3-continued

| GENE NAME | CNV Gene Region | Gene ID # | NCBI Gene ID | Gene Description | RefSeq Summmary |
|---|---|---|---|---|---|
| | | | | | some of which are found in cigarette smoke. The enzyme's endogenous substrate is unknown; however, it is able to metabolize some PAHs to carcinogenic intermediates. The gene has been associated with lung cancer risk. A related family member, CYP1A2, is located approximately 25 kb away from CYP1A1 on chromosome 15. [provided by RefSeq, July 2008]. Sequence Note: The RefSeq transcript and protein were derived from genomic sequence to make the sequence consistent with the reference genome assembly. The genomic coordinates used for the transcript record were based on alignments. |
| CYP51A1 | Exonic | 128 | 1595 | lanosterol 14-alpha demethylase isoform 2 | This gene encodes a member of the cytochrome P450 superfamily of enzymes. The cytochrome P450 proteins are monooxygenases which catalyze many reactions involved in drug metabolism and synthesis of cholesterol, steroids and other lipids. This endoplasmic reticulum protein participates in the synthesis of cholesterol by catalyzing the removal of the 14alpha-methyl group from lanosterol. Homologous genes are found in all three eukaryotic phyla, fungi, plants, and animals, suggesting that this is one of the oldest cytochrome P450 genes. Two transcript variants encoding different isoforms have been found for this gene. [provided by RefSeq, March 2009]. Transcript Variant: This variant (2) differs in the 5' UTR and coding sequence compared to variant 1. The resulting isoform (2) is shorter at the N-terminus compared to isoform 1. Sequence Note: This RefSeq record was created from transcript and genomic sequence data to make the sequence consistent with the reference genome assembly. The genomic coordinates used for the transcript record were based on transcript alignments. |
| DAPP1 | Exonic | 129 | 27071 | dual adapter for phosphotyrosine and 3-phosphotyrosine and 3-phosphoinositide | N/A |
| DCXR | Exonic | 130 | 51181 | L-xylulose reductase isoform 2 | The protein encoded by this gene acts as a homotetramer to catalyze diacetyl reductase and L-xylulose reductase reactions. The encoded protein may play a role in the uronate cycle of glucose metabolism and in the cellular osmoregulation in the proximal renal tubules. Defects in this gene are a cause of pentosuria. Two transcript variants encoding different isoforms have been found for this gene. [provided by RefSeq, August 2010]. Transcript Variant: This variant (2) uses an alternate in-frame splice junction at the 5' end of an exon compared to variant 1. The resulting isoform (2) has the same N- and C-termini but is 2 aa shorter compared to isoform 1. |
| DDX58 | Exonic | 131 | 23586 | probable ATP-dependent RNA helicase DDX58 | DEAD box proteins, characterized by the conserved motif Asp-Glu-Ala-Asp (DEAD), are putative RNA helicases which are implicated in a number of cellular processes involving RNA binding and alteration of RNA secondary structure. This gene encodes a protein containing RNA helicase-DEAD box protein motifs and a caspase recruitment domain (CARD). It is involved in viral double-stranded (ds) RNA recognition and the regulation of immune response. [provided by RefSeq, July 2008]. |
| DEFA6 | Exonic | 132 | 1671 | defensin-6 preproprotein | Defensins are a family of microbicidal and cytotoxic peptides thought to be involved in host defense. They are abundant in the granules of neutrophils and also found in the epithelia of mucosal surfaces such as those of the intestine, respiratory tract, urinary tract, and vagina. Members of the defensin family are |

TABLE 3-continued

| GENE NAME | CNV Gene ID # | Gene Region | NCBI Gene ID | Gene Description | RefSeq Summmary |
|---|---|---|---|---|---|
| | | | | | highly similar in protein sequence and distinguished by a conserved cysteine motif. Several alpha defensin genes appear to be clustered on chromosome 8. The protein encoded by this gene, defensin, alpha 6, is highly expressed in the secretory granules of Paneth cells of the small intestine, and likely plays a role in host defense of human bowel. [provided by RefSeq, July 2008]. |
| DEFB1 | 133 | Exonic | 1672 | beta-defensin 1 preproprotein | Defensins form a family of microbicidal and cytotoxic peptides made by neutrophils. Members of the defensin family are highly similar in protein sequence. This gene encodes defensin, beta 1, an antimicrobial peptide implicated in the resistance of epithelial surfaces to microbial colonization. This gene maps in close proximity to defensin family member, defensin, alpha 1 and has been implicated in the pathogenesis of cystic fibrosis. [provided by RefSeq, July 2008]. |
| DHPS | 134 | Exonic | 1725 | N/A | This gene encodes a protein that is required for the formation of hypusine, a unique amino acid formed by the posttranslational modification of only one protein, eukaryotic translation initiation factor 5A. The encoded protein catalyzes the first step in hypusine formation by transferring the butylamine moiety of spermidine to a specific lysine residue of the eukaryotic translation initiation factor 5A precursor, forming an intermediate deoxyhypusine residue. Alternatively spliced transcript variants encoding multiple isoforms have been observed for this gene. [provided by RefSeq, May 2011]. Transcript Variant: This variant (5) lacks an alternate internal exon, compared to variant 1. This variant is represented as non-coding because the use of the 5'-most expected translational start codon, as used in variant 1, renders the transcript a candidate for nonsense-mediated mRNA decay (NMD). |
| DIAPH2 | 135 | Exonic | 1730 | protein diaphanous homolog 2 isoform 12C | The product of this gene belongs to the diaphanous subfamily of the formin homology family of proteins. This gene may play a role in the development and normal function of the ovaries. Defects in this gene have been linked to premature ovarian failure 2. Alternatively spliced transcript variants encoding different isoforms have been identified. [provided by RefSeq, July 2008]. Transcript Variant: This variant (12C) differs in the 3' UTR and the 3' coding region, compared to variant 156. The resulting isoform (isoform 12C) contains a distinct C-terminus, compared to isoform 156. |
| DMD | 136 | Exonic | 1756 | dystrophin Dp140c isoform | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp140 transcripts use exons 45-79, |

TABLE 3-continued

| GENE NAME | Gene ID # | CNV Gene Region | NCBI Gene ID | Gene Description | RefSeq Summmary |
|---|---|---|---|---|---|
| | 137 | Exonic | | | starting at a promoter/exon 1 located in intron 44. Dp140 transcripts have a long (1 kb) 5' UTR since translation is initiated in exon 51 (corresponding to aa 2461 of dystrophin). In addition to the alternative promoter and exon 1, differential splicing of exons 71-74 and 78 produces at least five Dp140 isoforms. Of these, this transcript (Dp140c) lacks exons 71-74. Sequence Note: This RefSeq record was created from transcript and genomic sequence data to make the sequence consistent with the reference genome assembly. The genomic coordinates used for the transcript record were based on transcript alignments. |
| DNAH3 | | | | dynein heavy chain 3, axonemal | N/A |
| DNASE1L3 | 138 | Exonic | 55567 | deoxyribonuclease gamma precursor | This gene encodes a member of the DNase family. The protein hydrolyzes DNA, is not inhibited by actin, and mediates the breakdown of DNA during apoptosis. Alternate transcriptional splice variants of this gene have been observed but have not been thoroughly characterized. [provided by RefSeq, July 2008]. |
| DNTTIP2 | 139 | Exonic | 30836 | deoxynucleotidyl-transferase terminal-interacting protein 2 | This gene is thought to be involved in chromatin remodeling and gene transcription. The encoded nuclear protein binds to and enhances the transcriptional activity of the estrogen receptor alpha, and also interacts with terminal deoxynucleotidyltransferase. The expression profile of this gene is a potential biomarker for chronic obstructive pulmonary disease. [provided by RefSeq, December 2010]. |
| DPP6 | 140 | Exonic | 1804 | dipeptidyl aminopeptidase-like protein 6 isoform 2 | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Alternate transcriptional splice variants, encoding different isoforms, have been characterized. [provided by RefSeq, July 2008]. Transcript Variant: This variant (2) includes an alternate in-frame exon, compared to variant 1, resulting in a shorter protein (isoform 2, also referred to as S) that has a shorter and distinct N-terminus, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| DPYD | 141 | Exonic | 1806 | dihydropyrimidine dehydrogenase [NADP+] isoform 1 | The protein encoded by this gene is a pyrimidine catabolic enzyme and the initial and rate-limiting factor in the pathway of uracil and thymidine catabolism. Mutations in this gene result in dihydropyrimidine dehydrogenase deficiency, an error in pyrimidine metabolism associated with thymine-uraciluria and an increased risk of toxicity in cancer patients receiving 5-fluorouracil chemotherapy. Two transcript variants encoding different isoforms have been found for this gene. [provided by RefSeq, May 2009]. Transcript Variant: This variant (1) represents the longer transcript and encodes the longer isoform (1). |
| DUS1L | 142 | Exonic | 64118 | tRNA-dihydrouridine synthase 1-like | N/A |

TABLE 3-continued

| GENE NAME | Gene ID # | CNV Gene Region | NCBI Gene ID | Gene Description | RefSeq Summmary |
|---|---|---|---|---|---|
| DYNC2LI1 | 143 | Exonic | 51626 | cytoplasmic dynein 2 light intermediate chain 1 isoform 4 | N/A |
| DYSFIP1 | 144 | Exonic | N/A | N/A | N/A |
| EBF3 | 145 | Exonic | 253738 | transcription factor COE3 | This gene encodes a member of the early B-cell factor (EBF) family of DNA binding transcription factors. EBF proteins are involved in B-cell differentiation, bone development and neurogenesis, and may also function as tumor suppressors. The encoded protein inhibits cell survival through the regulation of genes involved in cell cycle arrest and apoptosis, and aberrant methylation or deletion of this gene may play a role in multiple malignancies including glioblastoma multiforme and gastric carcinoma. [provided by RefSeq, September 2011]. |
| EFTUD1 | 146 | Exonic | 79631 | elongation factor Tu GTP-binding domain-containing protein 1 isoform 2 | N/A |
| EHD3 | 147 | Exonic | 30845 | EH domain-containing protein 3 | N/A |
| ELAVL3 | 148 | Exonic | 1995 | ELAV-like protein 3 isoform 2 | A member of the ELAVL protein family, ELAV-like 3 is a neural-specific RNA-binding protein which contains three RNP-type RNA recognition motifs. The observation that ELAVL3 is one of several Hu antigens (neuronal-specific RNA-binding proteins) recognized by the anti-Hu serum antibody present in sera from patients with paraneoplastic encephalomyelitis and sensory neuronopathy (PEM/PSN) suggests it has a role in neurogenesis. Two alternatively spliced transcript variants encoding distinct isoforms have been found for this gene. [provided by RefSeq, July 2008]. Transcript Variant: This variant (2) lacks an in-frame segment in the coding region, as compared to variant 1. It encodes isoform 2 which lacks an internal segment, as compared to isoform 1. |
| ELK3 | 149 | Exonic | 2004 | ETS domain-containing protein Elk-3 | The protein encoded by this gene is a member of the ETS-domain transcription factor family and the ternary complex factor (TCF) subfamily. Proteins in this subfamily regulate transcription when recruited by serum response factor to bind to serum response elements. This protein is activated by signal-induced phosphorylation; studies in rodents suggest that it is a transcriptional inhibitor in the absence of Ras, but activates transcription when Ras is present. [provided by RefSeq, July 2008]. |
| EMCN | 150 | Exonic | 51705 | endomucin isoform 1 | EMCN is a mucin-like sialoglycoprotein that interferes with the assembly of focal adhesion complexes and inhibits interaction between cells and the extracellular matrix (Kinoshita et al., 2001 [PubMed 11418125]). [supplied by OMIM, March 2008]. Transcript Variant: This variant (1) represents the longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. |
| EMID2 | 151 | Exonic | 136227 | collagen alpha-1(XXVI) chain precursor | N/A |
| EPHA8 | 152 | Exonic | 2046 | ephrin type-A receptor 8 isoform | This gene encodes a member of the ephrin receptor subfamily of the protein-tyrosine kinase family. EPH and EPH-related receptors have been implicated in |

TABLE 3-continued

| GENE NAME | CNV Gene ID # | Gene Region | NCBI Gene ID | Gene Description | RefSeq Summary |
|---|---|---|---|---|---|
| | | | | 2 precursor | mediating developmental events, particularly in the nervous system. Receptors in the EPH subfamily typically have a single kinase domain and an extracellular region containing a Cys-rich domain and 2 fibronectin type III repeats. The ephrin receptors are divided into 2 groups based on the similarity of their extracellular domain sequences and their affinities for binding ephrin-A and ephrin-B ligands. The protein encoded by this gene functions as a receptor for ephrin A2, A3 and A5 and plays a role in short-range contact-mediated axonal guidance during development of the mammalian nervous system. [provided by RefSeq, July 2008]. Transcript Variant: This variant (2) uses an alternate splice site in the 3' coding region, compared to variant 1, that results in a frameshift. It encodes isoform 2, which has a shorter and distinct C-terminus compared to isoform 1. This transcript is supported by mRNA transcripts but the predicted ORF and its predicted precursor sequence have not yet been experimentally confirmed. |
| EPS8L3 | 153 | Exonic | 79574 | epidermal growth factor receptor kinase substrate 8-like protein 3 isoform c | This gene encodes a protein that is related to epidermal growth factor receptor pathway substrate 8 (EPS8), a substrate for the epidermal growth factor receptor. The function of this protein is unknown. Alternatively spliced transcript variants encoding different isoforms exist. [provided by RefSeq, July 2008]. Transcript Variant: This variant (3) uses different splice acceptor sites for two coding region exons compared to variant 1. The encoded protein (isoform c) is shorter when it is compared to isoform a. |
| EPSTI1 | 154 | Exonic | 94240 | epithelial-stromal interaction protein 1 isoform 1 | N/A |
| ETS1 | 155 | Exonic | 2113 | protein C-ets-1 isoform 1 | This gene encodes a member of the ETS family of transcription factors, which are defined by the presence of a conserved ETS DNA-binding domain that recognizes the core consensus DNA sequence GGAA/T in target genes. These proteins function either as transcriptional activators or repressors of numerous genes, and are involved in stem cell development, cell senescence and death, and tumorigenesis. Alternatively spliced transcript variants encoding different isoforms have been described for this gene. [provided by RefSeq, July 2011]. Transcript Variant: This variant (1) encodes the longest isoform (1). |
| F8A1 | 156 | Exonic | 8263 | factor VIII intron 22 protein | This gene is contained entirely within intron 22 of the factor VIII gene; spans less than 2 kb, and is transcribed in the direction opposite of factor VIII. A portion of intron 22 (int22h), containing F8A, is repeated twice extragenically closer to the Xq telomere. Although its function is unknown, the observation that this gene is conserved in the mouse implies it has some function. Unlike factor VIII, this gene is transcribed abundantly in a wide variety of cell types. [provided by RefSeq, July 2008]. |
| F8A2 | 157 | Exonic | 474383 | factor VIII intron 22 protein | This gene is part of a region that is repeated three times on chromosome X, once in intron 22 of the F8 gene and twice closer to the Xq telomere. This record represents the middle copy. Although its function is unknown, the observation that this gene is conserved in the mouse implies it has some function. Unlike factor VIII, this gene is transcribed abundantly in a wide variety of cell types. [provided by RefSeq, July 2008]. |
| F8A3 | 158 | Exonic | 474384 | factor VIII intron 22 protein | This gene is part of a region that is repeated three times on chromosome X, once in intron 22 of the F8 gene and twice closer to the Xq telomere. This record represents the most telomeric copy. Although its function is unknown, the observation that this gene is conserved in the mouse implies it has some |

TABLE 3-continued

| GENE NAME | CNV Gene ID # | Gene Region | NCBI Gene ID | Gene Description | RefSeq Summmary |
|---|---|---|---|---|---|
| FA2H | 159 | Exonic | 79152 | fatty acid 2-hydroxylase | function. Unlike factor VIII, this gene is transcribed abundantly in a wide variety of cell types. [provided by RefSeq, July 2008]. This gene encodes a protein that catalyzes the synthesis of 2-hydroxysphingolipids, a subset of sphingolipids that contain 2-hydroxy fatty acids. Sphingolipids play roles in many cellular processes and their structural diversity arises from modification of the hydrophobic ceramide moiety, such as by 2-hydroxylation of the N-acyl chain, and the existence of many different head groups. Mutations in this gene have been associated with leukodystrophy dysmyelinating with spastic paraparesis with or without dystonia. [provided by RefSeq, March 2010]. |
| FAM154B | 160 | Exonic | 283726 | protein FAM154B | N/A |
| FAM189A1 | 161 | Exonic | 23359 | protein FAM189A1 | N/A |
| FAM83G | 162 | Exonic | 644815 | protein FAM83G | N/A |
| FAM9B | 163 | Exonic | 171483 | protein FAM9B | This gene is a member of a gene family which arose through duplication on the X chromosome. The encoded protein may be localized to the nucleus as the protein contains several nuclear localization signals, and has similarity to a synaptonemal complex protein. [provided by RefSeq, August 2011]. |
| FANCA | 164 | Exonic | 2175 | Fanconi anemia group A protein isoform a | The Fanconi anemia complementation group (FANC) currently includes FANCA, FANCB, FANCC, FANCD1 (also called BRCA2), FANCD2, FANCE, FANCF, FANCG, FANCI, FANCJ (also called BRIP1), FANCL, FANCM and FANCN (also called PALB2). The previously defined group FANCH is the same as FANCA. Fanconi anemia is a genetically heterogeneous recessive disorder characterized by cytogenetic instability, hypersensitivity to DNA crosslinking agents, increased chromosomal breakage, and defective DNA repair. The members of the Fanconi anemia complementation group do not share sequence similarity; they are related by their assembly into a common nuclear protein complex. This gene encodes the protein for complementation group A. Alternative splicing results in multiple transcript variants encoding different isoforms. Mutations in this gene are the most common cause of Fanconi anemia. [provided by RefSeq, July 2008]. Transcript Variant: This variant (1) represents the longer transcript and encodes the longer isoform (a). |
| FASN | 165 | Exonic | 2194 | fatty acid synthase | The enzyme encoded by this gene is a multifunctional protein. Its main function is to catalyze the synthesis of palmitate from acetyl-CoA and malonyl-CoA, in the presence of NADPH, into long-chain saturated fatty acids. In some cancer cell lines, this protein has been found to be fused with estrogen receptor-alpha (ER-alpha), in which the N-terminus of FAS is fused in-frame with the C-terminus of ER-alpha. [provided by RefSeq, July 2008]. |
| FBXO18 | 166 | Exonic | 84893 | F-box only protein 18 isoform 1 | This gene encodes a member of the F-box protein family, members of which are characterized by an approximately 40 amino acid motif, the F-box. The F-box proteins constitute one of the four subunits of ubiquitin protein ligase complex called SCFs (SKP1-cullin-F-box), which function in phosphorylation-dependent ubiquitination. The F-box proteins are divided into three classes: Fbws containing WD-40 domains, Fbls containing leucine-rich repeats, and Fbxs containing either different protein-protein interaction modules or no recognizable motifs. The protein encoded by this gene belongs to the Fbx class. It contains an F-box motif and seven conserved helicase motifs, and has both DNA-dependent ATPase and DNA unwinding activities. Alternatively spliced transcript variants encoding distinct isoforms have been identified for this gene. |

TABLE 3-continued

| GENE NAME | Gene ID # | CNV Gene Region | NCBI Gene ID | Gene Description | RefSeq Summmary |
|---|---|---|---|---|---|
| FER1L4 | 167 | Exonic | 80307 | N/A | [provided by RefSeq, July 2008]. Transcript Variant: This variant (1) encodes the longer isoform (1). |
| FHIT | 168 | Exonic | 2272 | bis(5'-adenosyl)-triphosphatase | N/A This gene, a member of the histidine triad gene family, encodes a diadenosine 5',5'''-P1,P3-triphosphate hydrolase involved in purine metabolism. The gene encompasses the common fragile site FRA3B on chromosome 3, where carcinogen-induced damage can lead to translocations and aberrant transcripts of this gene. In fact, aberrant transcripts from this gene have been found in about half of all esophageal, stomach, and colon carcinomas. Alternatively spliced transcript variants have been found for this gene. [provided by RefSeq, October 2009]. Transcript Variant: This variant (2) has an alternate splice site in the 3' UTR, as compared to variant 1. Both variants 1 and 2 encode the same protein. |
| FNTA | 169 | Exonic | 2339 | protein farnesyltransferase/geranylgeranyltransferase type-1 subunit alpha | Prenyltransferases can attach either a farnesyl group or a geranylgeranyl group in thioether linkage to the cysteine residue of proteins with a C-terminal CAAX box. CAAX geranylgeranyltransferase and CAAX farnesyltransferase are heterodimers that share the same alpha subunit but have different beta subunits. This gene encodes the alpha subunit of these transferases. Alternative splicing results in multiple transcript variants. Related pseudogenes have been identified on chromosomes 11 and 13. [provided by RefSeq, May 2010]. Transcript Variant: This variant (1) represents the longer transcript and encodes the functional protein. |
| FRG1 | 170 | Exonic | 2483 | protein FRG1 | This gene maps to a location 100 kb centromeric of the repeat units on chromosome 4q35 which are deleted in facioscapulohumeral muscular dystrophy (FSHD). It is evolutionarily conserved and has related sequences on multiple human chromosomes but DNA sequence analysis did not reveal any homology to known genes. In vivo studies demonstrate the encoded protein is localized to the nucleolus. [provided by RefSeq, July 2008]. |
| FSCN2 | 171 | Exonic | 25794 | fascin-2 isoform 2 | This gene encodes a member of the fascin protein family. Fascins crosslink actin into filamentous bundles within dynamic cell extensions. This family member is proposed to play a role in photoreceptor disk morphogenesis. A mutation in this gene results in one form of autosomal dominant retinitis pigmentosa and macular degeneration. Multiple transcript variants encoding different isoforms have been found for this gene. [provided by RefSeq, July 2008]. Transcript Variant: This variant (2) represents the longer transcript and encodes the longer isoform (2). Sequence Note: This RefSeq record was created from transcript and genomic sequence data to make the sequence consistent with the reference genome assembly. The genomic coordinates used for the transcript record were based on transcript alignments. |
| FUT2 | 172 | Exonic | 2524 | galactoside 2-alpha-L-fucosyltransferase 2 | The protein encoded by this gene is a Golgi stack membrane protein that is involved in the creation of a precursor of the H antigen, which is required for the final step in the soluble A and B antigen synthesis pathway. This gene is one of two encoding the galactoside 2-L-fucosyltransferase enzyme. Two transcript variants encoding the same protein have been found for this gene. [provided by RefSeq, July 2008]. Transcript Variant: This variant (2) differs in the 5' UTR compared to variant 1. Variants 1 and 2 both encode the same protein. Sequence Note: This RefSeq record was created from transcript and genomic sequence data because no single transcript was available for the full length of the gene. The extent of this transcript is supported by transcript alignments. Sequence Note: This RefSeq record represents the SE*01.01.01 allele. |

TABLE 3-continued

| GENE NAME | Gene ID # | CNV Gene Region | NCBI Gene ID | Gene Description | RefSeq Summmary |
|---|---|---|---|---|---|
| GATA6 | 173 | Exonic | 2627 | transcription factor GATA-6 | N/A |
| GIT2 | 174 | Exonic | 9815 | ARF GTPase-activating protein GIT2 isoform 6 | This gene encodes a member of the GIT protein family, which interact with G protein-coupled receptor kinases and possess ADP-ribosylation factor (ARF) GTPase-activating protein (GAP) activity. GIT proteins traffic between cytoplasmic complexes, focal adhesions, and the cell periphery, and interact with Pak interacting exchange factor beta (PIX) to form large oligomeric complexes that transiently recruit other proteins. GIT proteins regulate cytoskeletal dynamics and participate in receptor internalization and membrane trafficking This gene has been shown to repress lamellipodial extension and focal adhesion turnover, and is thought to regulate cell motility. This gene undergoes extensive alternative splicing to generate multiple isoforms, but the full-length nature of some of these variants has not been determined. The various isoforms have functional differences, with respect to ARF GAP activity and to G protein-coupled receptor kinase 2 binding. [provided by RefSeq, September 2008]. Transcript Variant: This variant (6) lacks two in-frame exons in the 3' coding region and includes an additional short in-frame exon in the central coding region, compared to isoform 1. The resulting isoform (6) is missing two internal fragments and includes a 2 residue insertion, compared to isoform 1. |
| GLDC | 175 | Exonic | 2731 | glycine dehydrogenase [decarboxylating], mitochondrial precursor | Degradation of glycine is brought about by the glycine cleavage system, which is composed of four mitochondrial protein components: P protein (a pyridoxal phosphate-dependent glycine decarboxylase), H protein (a lipoic acid-containing protein), T protein (a tetrahydrofolate-requiring enzyme), and L protein (a lipoamide dehydrogenase). The protein encoded by this gene is the P protein, which binds to glycine and enables the methylamine group from glycine to be transferred to the T protein. Defects in this gene are a cause of nonketotic hyperglycinemia (NKH). [provided by RefSeq, January 2010]. |
| GLRX | 176 | Exonic | 2745 | glutaredoxin-1 | This gene encodes a member of the glutaredoxin family. The encoded protein is a cytoplasmic enzyme catalyzing the reversible reduction of glutathione-protein mixed disulfides. This enzyme highly contributes to the antioxidant defense system. It is crucial for several signalling pathways by controlling the S-glutathionylation status of signalling mediators. It is involved in beta-amyloid toxicity and Alzheimer's disease. Multiple alternatively spliced transcript variants encoding the same protein have been identified. [provided by RefSeq, August 2011]. Transcript Variant: This variant (3) differs in the 3' UTR, compared to variant 1. Variants 1-4 encode the same protein. Sequence Note: This RefSeq record was created from transcript and genomic sequence data to make the sequence consistent with the reference genome assembly. The genomic coordinates used for the transcript record were based on transcript alignments. |
| GNE | 177 | Exonic | 10020 | bifunctional UDP-N-acetylglucosamine 2-epimerase/N-acetylmannosamine kinase isoform 4 | The protein encoded by this gene is a bifunctional enzyme that initiates and regulates the biosynthesis of N-acetylneuraminic acid (NeuAc), a precursor of sialic acids. It is a rate-limiting enzyme in the sialic acid biosynthetic pathway. Sialic acid modification of cell surface molecules is crucial for their function in many biologic processes, including cell adhesion and signal transduction. Differential sialylation of cell surface molecules is also implicated in the tumorigenicity and metastatic behavior of malignant cells. Mutations in this gene are associated with sialuria, autosomal recessive inclusion body myopathy, and Nonaka myopathy. Alternative splicing of this gene results in transcript variants encoding different isoforms. [provided by RefSeq, July 2008]. Transcript |

TABLE 3-continued

| GENE NAME | CNV Gene ID # | CNV Gene Region | NCBI Gene ID | Gene Description | RefSeq Summmary |
|---|---|---|---|---|---|
| GNRHR2 | 178 | Exonic | 114814 | N/A | Variant: This variant (4) contains a different 5' terminal exon and lacks a 3' coding region segment, compared to transcript variant 1, which results in translation initiation from an in-frame downstream AUG. The predicted protein (isoform 4) is shorter when it is compared to isoform 1. Sequence Note: This RefSeq record was created from transcript and genomic sequence data to make the sequence consistent with the reference genome assembly. The genomic coordinates used for the transcript record were based on transcript alignments. In non-hominoid primates and non-mammalian vertebrates, the gonadotropin releasing hormone 2 receptor (GnRHR2) encodes a seven-transmembrane G-protein coupled receptor. However, in human, the N-terminus of the predicted protein contains a frameshift and premature stop codon. In human, GnRHR2 transcription occurs but the gene does not likely produce a functional C-terminal multi-transmembrane protein. A non-transcribed pseudogene of GnRHR2 is located on chromosome 14. [provided by RefSeq, February 2011]. Publication Note: This RefSeq record includes a subset of the publications that are available for this gene. Please see the Gene record to access additional publications. |
| GPR98 | 179 | Exonic | 84059 | G-protein coupled receptor 98 precursor | This gene encodes a member of the G-protein coupled receptor superfamily. The encoded protein contains a 7-transmembrane receptor domain, binds calcium and is expressed in the central nervous system. Mutations in this gene are associated with Usher syndrome 2 and familial febrile seizures. Several alternatively spliced transcripts have been described. [provided by RefSeq, July 2008]. Transcript Variant: This variant (1), also known as VLGR1b, encodes the predominant isoform (1). Publication Note: This RefSeq record includes a subset of the publications that are available for this gene. Please see the Gene record to access additional publications. |
| GPS1 | 180 | Exonic | 2873 | COP9 signalosome complex subunit 1 isoform 2 | This gene is known to suppress G-protein and mitogen-activated signal transduction in mammalian cells. The encoded protein shares significant similarity with Arabidopsis FUSE, which is a regulator of light-mediated signal transduction in plant cells. Two alternatively spliced transcript variants encoding different isoforms have been found for this gene. [provided by RefSeq, July 2008]. Transcript Variant: This variant (2) lacks an internal segment in the 5' region and uses an upstream translation start codon, as compared to variant 1. It encodes isoform 2 which has a shorter and distinct N-terminus, as compared to isoform 1. |
| GRAMD4 | 181 | Exonic | 23151 | GRAM domain-containing protein 4 | GRAMD4 is a mitochondrial effector of E2F1 (MIM 189971)-induced apoptosis (Stanelle et al., 2005 [PubMed 15565177]). [supplied by OMIM, January 2011]. Sequence Note: This RefSeq record was created from transcript and genomic sequence data to make the sequence consistent with the reference genome assembly. The genomic coordinates used for the transcript record were based on transcript alignments. |
| GRIN2D | 182 | Exonic | 2906 | glutamate [NMDA] receptor subunit epsilon-4 precursor | N-methyl-D-aspartate (NMDA) receptors are a class of ionotropic glutamate receptors. NMDA channel has been shown to be involved in long-term potentiation, an activity-dependent increase in the efficiency of synaptic transmission thought to underlie certain kinds of memory and learning. NMDA receptor channels are heteromers composed of the key receptor subunit NMDAR1 (GRIN1) and 1 or more of the 4 NMDAR2 subunits: NMDAR2A (GRIN2A), NMDAR2B (GRIN2B), NMDAR2C (GRIN2C), and NMDAR2D (GRIN2D). [provided by RefSeq, March 2010]. |

TABLE 3-continued

| GENE NAME | Gene ID # | CNV Gene Region | NCBI Gene ID | Gene Description | RefSeq Summmary |
|---|---|---|---|---|---|
| GRIPAP1 | 183 | Exonic | 56850 | GRIP1-associated protein 1 isoform 2 | This gene encodes a guanine nucleotide exchange factor for the Ras family of small G proteins (RasGEF). In brain studies, the encoded protein was found with the GRIP/AMPA receptor complex. Multiple alternatively spliced transcript variants have been described that encode different protein isoforms; however, the full-length nature and biological validity of all of these variants have not been determined. [provided by RefSeq, November 2009]. Transcript Variant: This variant (2) lacks an alternate in-frame coding region segment and uses a different splice site in the 3' coding region, compared to variant 1. The reading frame is changed, such that the resulting protein (isoform 2) has a shorter and distinct C-terminus when compared to isoform 1. |
| GTPBP10 | 184 | Exonic | 85865 | GTP-binding protein 10 isoform 1 | Small G proteins, such as GTPBP10, act as molecular switches that play crucial roles in the regulation of fundamental cellular processes such as protein synthesis, nuclear transport, membrane trafficking, and signal transduction (Hirano et al., 2006 [PubMed 17054726]). [supplied by OMIM, March 2008]. Transcript Variant: This variant (1) lacks alternate in-frame exons in the 5' coding region, compared to variant 2. The resulting protein (isoform 1) is shorter when it is compared to isoform 2. Sequence Note: This RefSeq record was created from transcript and genomic sequence data to make the sequence consistent with the reference genome assembly. The genomic coordinates used for the transcript record were based on transcript alignments. |
| GYG2 | 185 | Exonic | 8908 | glycogenin-2 isoform a | This gene encodes a member of the glycogenin family. Glycogenin is a self-glucosylating protein involved in the initiation reactions of glycogen biosynthesis. A gene on chromosome 3 encodes the muscle glycogenin and this X-linked gene encodes the glycogenin mainly present in liver; both are involved in blood glucose homeostasis. This gene has a short version on chromosome Y, which is 3' truncated and can not make a functional protein. Multiple alternatively spliced transcript variants encoding different isoforms have been identified. [provided by RefSeq, May 2010]. Transcript Variant: This variant (1) lacks an in-frame exon in the CDS, as compared to variant 2. The resulting isoform (a) lacks an internal segment, as compared to isoform b. |
| H2AFB1 | 186 | Exonic | 474382 | histone H2A-Bbd type 1 | Histones are basic nuclear proteins that are responsible for the nucleosome structure of the chromosomal fiber in eukaryotes. Nucleosomes consist of approximately 146 bp of DNA wrapped around a histone octamer composed of pairs of each of the four core histones (H2A, H2B, H3, and H4). The chromatin fiber is further compacted through the interaction of a linker histone, H1, with the DNA between the nucleosomes to form higher order chromatin structures. This gene encodes a member of the histone H2A family. This gene is part of a region that is repeated three times on chromosome X, once in intron 22 of the F8 gene and twice closer to the Xq telomere. This record represents the most centromeric copy which is in intron 22 of the F8 gene. [provided by RefSeq, July 2008]. |
| H2AFB2 | 187 | Exonic | 474381 | histone H2A-Bbd type 2/3 | Histones are basic nuclear proteins that are responsible for the nucleosome structure of the chromosomal fiber in eukaryotes. Nucleosomes consist of approximately 146 bp of DNA wrapped around a histone octamer composed of pairs of each of the four core histones (H2A, H2B, H3, and H4). The chromatin fiber is further compacted through the interaction of a linker histone, H1, with the DNA between the nucleosomes to form higher order chromatin structures. This gene encodes a member of the histone H2A family. This gene is part of a region that is repeated three times on chromosome X, once in intron 22 of the F8 |

TABLE 3-continued

| GENE NAME | Gene ID # | CNV Gene Region | NCBI Gene ID | Gene Description | RefSeq Summary |
|---|---|---|---|---|---|
|  | 188 |  |  |  | gene and twice closer to the Xq telomere. This record represents the middle copy. [provided by RefSeq, July 2008]. Sequence Note: The RefSeq transcript and protein were derived from genomic sequence to make the sequence consistent with the reference genome assembly. The genomic coordinates used for the transcript record were based on alignments. |
| H2AFB3 |  | Exonic | 83740 | histone H2A-Bbd type 2/3 | Histones are basic nuclear proteins that are responsible for the nucleosome structure of the chromosomal fiber in eukaryotes. Nucleosomes consist of approximately 146 bp of DNA wrapped around a histone octamer composed of pairs of each of the four core histones (H2A, H2B, H3, and H4). The chromatin fiber is further compacted through the interaction of a linker histone, H1, with the DNA between the nucleosomes to form higher order chromatin structures. This gene encodes a member of the histone H2A family. This gene is part of a region that is repeated three times on chromosome X, once in intron 22 of the F8 gene and twice closer to the Xq telomere. This record represents the most telomeric copy. [provided by RefSeq, July 2008]. |
| HACE1 | 189 | Exonic | 57531 | E3 ubiquitin-protein ligase HACE1 | N/A |
| HCG9 | 190 | Exonic | 10255 | N/A | This gene lies within the MHC class I region on chromosome 6p21.3. This gene is believed to be non-coding, but its function has not been determined. [provided by RefSeq, July 2009]. |
| HEATR4 | 191 | Exonic | 399671 | HEAT repeat-containing protein 4 | N/A |
| HECTD1 | 192 | Exonic | 25831 | E3 ubiquitin-protein ligase HECTD1 | N/A |
| HFE2 | 193 | Exonic | 148738 | hemojuvelin isoform c | The product of this gene is involved in iron metabolism. It may be a component of the signaling pathway which activates hepcidin or it may act as a modulator of hepcidin expression. It could also represent the cellular receptor for hepcidin. Alternatively spliced transcript variants encoding different isoforms have been identified for this gene. Defects in this gene are the cause of hemochromatosis type 2A, also called juvenile hemochromatosis (JH). JH is an early-onset autosomal recessive disorder due to severe iron overload resulting in hypogonadotrophic hypogonadism, hepatic fibrosis or cirrhosis and cardiomyopathy, occurring typically before age of 30. [provided by RefSeq, July 2008]. Transcript Variant: This variant (c) lacks two segments in the 5' UTR and an in-frame portion of the 5' coding region, compared to variant a. The resulting isoform (c) has a shorter N-terminus when compared to isoform a. Variants c and d encode the same isoform (c). |
| HFM1 | 194 | Exonic | 164045 | probable ATP-dependent DNA helicase HFM1 | N/A |
| HGS | 195 | Exonic | 9146 | hepatocyte growth factor-regulated tyrosine kinase substrate | The protein encoded by this gene regulates endosomal sorting and plays a critical role in the recycling and degradation of membrane receptors. The encoded protein sorts monoubiquitinated membrane proteins into the multivesicular body, targeting these proteins for lysosome-dependent degradation. [provided by RefSeq, December 2010]. |
| HGSNAT | 196 | Exonic | 138050 | heparan-alpha-glucosaminide N- | This gene encodes a lysosomal acetyltransferase, which is one of several enzymes involved in the lysosomal degradation of heparin sulfate. Mutations in |

TABLE 3-continued

| GENE NAME | Gene ID # | CNV Gene Region | NCBI Gene ID | Gene Description | RefSeq Summmary |
|---|---|---|---|---|---|
| HOMEZ | 197 | Exonic | 57594 | homeobox and leucine zipper protein Homez | this gene are associated with Sanfilippo syndrome C, one type of the lysosomal storage disease mucopolysaccaridosis III, which results from impaired degradation of heparan sulfate. [provided by RefSeq, January 2009]. |
| IFNA1 | 198 | Exonic | 3439 | interferon alpha-1/13 precursor | N/A |
| | | | | | The protein encoded by this gene is produced by macrophages and has antiviral activity. This gene is intronless and the encoded protein is secreted. [provided by RefSeq, September 2011]. |
| IFNA22P | 199 | Exonic | 3453 | N/A | N/A |
| IL1RAPL1 | 200 | Exonic | 11141 | interleukin-1 receptor accessory protein-like 1 precursor | The protein encoded by this gene is a member of the interleukin 1 receptor family and is similar to the interleukin 1 receptor accessory proteins. It is most closely related to interleukin 1 receptor accessory protein-like 2 (IL1RAPL2). This gene and IL1RAPL2 are located at a region on chromosome X that is associated with X-linked non-syndromic mental retardation. Deletions and mutations in this gene were found in patients with mental retardation. This gene is expressed at a high level in post-natal brain structures involved in the hippocampal memory system, which suggests a specialized role in the physiological processes underlying memory and learning abilities. [provided by RefSeq, July 2008]. |
| IL32 | 201 | Exonic | 9235 | interleukin-32 isoform D | This gene encodes a member of the cytokine family. The protein contains a tyrosine sulfation site, 3 potential N-myristoylation sites, multiple putative phosphorylation sites, and an RGD cell-attachment sequence. Expression of this protein is increased after the activation of T-cells by mitogens or the activation of NK cells by IL-2. This protein induces the production of TNFalpha from macrophage cells. Alternate transcriptional splice variants, encoding different isoforms, have been characterized. [provided by RefSeq, July 2008]. Transcript Variant: This variant (7) lacks two alternate exons in the 5' UTR and an alternate in-frame exon within the coding region, compared to variant 1, resulting in a shorter protein (isoform D). |
| IMP3 | 202 | Exonic | 55272 | U3 small nucleolar ribonucleoprotein protein IMP3 | This gene encodes the human homolog of the yeast Imp3 protein. The protein localizes to the nucleoli and interacts with the U3 snoRNP complex. The protein contains an S4 domain. [provided by RefSeq, July 2008]. |
| INO80D | 203 | Exonic | 54891 | INO80 complex subunit D | N/A |
| INTS2 | 204 | Exonic | 57508 | integrator complex subunit 2 | INTS2 is a subunit of the Integrator complex, which associates with the C-terminal domain of RNA polymerase II large subunit (POLR2A; MIM 180660) and mediates 3-prime end processing of small nuclear RNAs U1 (RNU1; MIM 180680) and U2 (RNU2; MIM 180690) (Baillat et al., 2005 [PubMed 16239144]). [supplied by OMIM, March 2008]. Transcript Variant: This variant (1) is the protein-coding variant. Sequence Note: This RefSeq record was created from transcript and genomic sequence data because no single transcript was available for the full length of the gene. The extent of this transcript is supported by transcript alignments. |
| IRAK2 | 205 | Exonic | 3656 | interleukin-1 receptor-associated kinase-like 2 | IRAK2 encodes the interleukin-1 receptor-associated kinase 2, one of two putative serine/threonine kinases that become associated with the interleukin-1 receptor (IL1R) upon stimulation. IRAK2 is reported to participate in the IL1-induced upregulation of NF-kappaB. [provided by RefSeq, July 2008]. |
| ITGA10 | 206 | Exonic | 8515 | integrin alpha-10 precursor | Integrins are integral membrane proteins composed of an alpha chain and a beta chain, and are known to participate in cell adhesion as well as cell-surface |

TABLE 3-continued

| GENE NAME | Gene ID # | CNV Gene Region | NCBI Gene ID | Gene Description | RefSeq Summmary |
|---|---|---|---|---|---|
| KAL1 | 207 | Exonic | 3730 | anosmin-1 precursor | mediated signalling. The I-domain containing alpha 10 combines with the integrin beta 1 chain (ITGB1) to form a novel collagen type II-binding integrin expressed in cartilage tissue. [provided by RefSeq, July 2008]. Mutations in this gene cause the X-linked Kallmann syndrome. The encoded protein is similar in sequence to proteins known to function in neural cell adhesion and axonal migration. In addition, this cell surface protein is N-glycosylated and may have anti-protease activity. [provided by RefSeq, July 2008]. |
| KCND1 | 208 | Exonic | 3750 | potassium voltage-gated channel subfamily D member 1 precursor | Voltage-gated potassium (Kv) channels represent the most complex class of voltage-gated ion channels from both functional and structural standpoints. Their diverse functions include regulating neurotransmitter release, heart rate, insulin secretion, neuronal excitability, epithelial electrolyte transport, smooth muscle contraction, and cell volume. Four sequence-related potassium channel genes - shaker, shaw, shab, and shal - have been identified in Drosophila, and each has been shown to have human homolog(s). This gene encodes a member of the potassium channel, voltage-gated, shal-related subfamily, members of which form voltage-activated A-type potassium ion channels and are prominent in the repolarization phase of the action potential. This gene is expressed at moderate levels in all tissues analyzed, with lower levels in skeletal muscle. [provided by RefSeq, July 2008]. Sequence Note: The RefSeq transcript and protein were derived from genomic sequence to make the sequence consistent with the reference genome assembly. The genomic coordinates used for the transcript record were based on alignments. |
| KIAA0562 | 209 | Exonic | N/A | N/A | N/A |
| KIAA1267 | 210 | Exonic | 284058 | MLL1/MLL complex subunit KIAA1267 isoform 1 | N/A |
| KIAA1432 | 211 | Exonic | 57589 | protein RIC1 homolog isoform b | N/A |
| KIF12 | 212 | Exonic | 113220 | kinesin-like protein KIF12 | KIF12 is a member of the kinesin superfamily of microtubule-associated molecular motors (see MIM 148760) that play important roles in intracellular transport and cell division (Nakagawa et al., 1997 [PubMed 9275178]). [supplied by OMIM, March 2008]. |
| KIF26B | 213 | Exonic | 55083 | kinesin-like protein KIF26B | N/A |
| KIF7 | 214 | Exonic | 374654 | kinesin-like protein KIF7 | This gene encodes a cilia-associated protein belonging to the kinesin family. This protein plays a role in the sonic hedgehog (SHH) signaling pathway through the regulation of GLI transcription factors. It functions as a negative regulator of the SHH pathway by preventing inappropriate activation of GLI2 in the absence of ligand, and as a positive regulator by preventing the processing of GLI3 into its repressor form. Mutations in this gene have been associated with various ciliopathies. [provided by RefSeq, October 2011]. |
| KIRREL3 | 215 | Exonic | 84623 | kin of IRRE-like protein 3 isoform 2 precursor | The protein encoded by this gene is a member of the nephrin-like protein family. These proteins are expressed in fetal and adult brain, and also in podocytes of kidney glomeruli. The cytoplasmic domains of these proteins interact with the C-terminus of podocin, also expressed in the podocytes, cells involved in ensuring size- and charge-selective ultrafiltration. Mutations in this gene are associated with mental retardation autosomal dominant type 4 (MRD4). Alternatively spliced transcript variants encoding different isoforms |

TABLE 3-continued

| GENE NAME | CNV Gene ID # | Gene Region | NCBI Gene ID | Gene Description | RefSeq Summary |
|---|---|---|---|---|---|
| KLHDC4 | 216 | Exonic | 54758 | kelch domain-containing protein 4 isoform 2 | have been found for this gene. [provided by RefSeq, September 2009]. Transcript Variant: This variant (2) includes an alternate segment at the 3' end compared to variant 1. This results in a frame-shift, and a shorter isoform (2) with a distinct C-terminus compared to isoform 1. |
| KLHL9 | 217 | Exonic | 55958 | kelch-like protein 9 | N/A |
| KRT6C | 218 | Exonic | 286887 | keratin, type II cytoskeletal 6C | Keratins are intermediate filament proteins responsible for the structural integrity of epithelial cells and are subdivided into epithelial keratins and hair keratins. The type II keratins are clustered in a region of chromosome 12q13. [provided by RefSeq, July 2009]. |
| LAMC3 | 219 | Exonic | 10319 | laminin subunit gamma-3 precursor | Laminins, a family of extracellular matrix glycoproteins, are the major noncollagenous constituent of basement membranes. They have been implicated in a wide variety of biological processes including cell adhesion, differentiation, migration, signaling, neurite outgrowth and metastasis. Laminins are composed of 3 non identical chains: laminin alpha, beta and gamma (formerly A, B1, and B2, respectively) and they form a cruciform structure consisting of 3 short arms, each formed by a different chain, and a long arm composed of all 3 chains. Each laminin chain is a multidomain protein encoded by a distinct gene. Several isoforms of each chain have been described. Different alpha, beta and gamma chain isomers combine to give rise to different heterotrimeric laminin isoforms which are designated by Arabic numerals in the order of their discovery, i.e. alpha1beta1gamma1 heterotrimer is laminin 1. The biological functions of the different chains and trimer molecules are largely unknown, but some of the chains have been shown to differ with respect to their tissue distribution, presumably reflecting diverse functions in vivo. This gene encodes the gamma chain isoform laminin, gamma 3. The gamma 3 chain is most similar to the gamma 1 chain, and contains all the 6 domains expected of the gamma chain. It is a component of laminin 12. The gamma 3 chain is broadly expressed in skin, heart, lung, and the reproductive tracts. In skin, it is seen within the basement membrane of the dermal-epidermal junction at points of nerve penetration. Gamma 3 is also a prominent element of the apical surface of ciliated epithelial cells of lung, oviduct, epididymis, ductus deferens, and seminiferous tubules. The distribution of gamma 3-containing laminins along ciliated epithelial surfaces suggests that the apical laminins are important in the morphogenesis and structural stability of the ciliated processes of these cells. [provided by RefSeq, August 2011]. |
| LBH | 220 | Exonic | 81606 | protein LBH | N/A |
| LCE1C | 221 | Exonic | 353133 | late cornified envelope protein 1C | N/A |
| LEP | 222 | Exonic | 3952 | leptin precursor | This gene encodes a protein that is secreted by white adipocytes, and which plays a major role in the regulation of body weight. This protein, which acts through the leptin receptor, functions as part of a signaling pathway that can inhibit food intake and/or regulate energy expenditure to maintain constancy of the adipose mass. This protein also has several endocrine functions, and is involved in the regulation of immune and inflammatory responses, hematopoiesis, angiogenesis and wound healing. Mutations in this gene and/or |

TABLE 3-continued

| GENE NAME | Gene ID # | CNV Gene Region | NCBI Gene ID | Gene Description | RefSeq Summary |
|---|---|---|---|---|---|
| | 223 | Exonic | 3953 | leptin receptor isoform 3 precursor | its regulatory regions cause severe obesity, and morbid obesity with hypogonadism. This gene has also been linked to type 2 diabetes mellitus development. [provided by RefSeq, July 2008]. Sequence Note: This RefSeq record was created from transcript and genomic sequence data to make the sequence consistent with the reference genome assembly. The genomic coordinates used for the transcript record were based on transcript alignments. |
| LEPR | | | | | The protein encoded by this gene belongs to the gp130 family of cytokine receptors that are known to stimulate gene transcription via activation of cytosolic STAT proteins. This protein is a receptor for leptin (an adipocyte-specific hormone that regulates body weight), and is involved in the regulation of fat metabolism, as well as in a novel hematopoietic pathway that is required for normal lymphopoiesis. Mutations in this gene have been associated with obesity and pituitary dysfunction. Alternatively spliced transcript variants encoding different isoforms have been described for this gene. It is noteworthy that this gene and LEPROT gene (GeneID: 54741) share the same promoter and the first 2 exons, however, encode distinct proteins (PMID: 9207021). [provided by RefSeq, November 2010]. Transcript Variant: This variant (6) contains alternate 5' UTR and 3' terminal exon compared to variant 1, resulting in a shorter isoform (3) with a distinct C-terminus compared to isoform 1. Variants 3 and 6 encode the same isoform. |
| LIPT1 | 224 | Exonic | 51601 | lipoyltransferase 1, mitochondrial precursor | The process of transferring lipoic acid to proteins is a two-step process. The first step is the activation of lipoic acid by lipoate-activating enzyme to form lipoyl-AMP. For the second step, the protein encoded by this gene transfers the lipoyl moiety to apoproteins. Alternative splicing results in multiple transcript variants. A related pseudogene has been identified on chromosome 13. Read-through transcription also exists between this gene and the neighboring downstream mitochondrial ribosomal protein L30 (MRPL30) gene. [provided by RefSeq, March 2011]. Transcript Variant: This variant (1) encodes the same protein as variants 3-6. |
| LIX1L | 225 | Exonic | 128077 | LIX1-like protein | N/A |
| LOC100133308 | 226 | Exonic | 100133308 | N/A | N/A |
| LOC100289187 | 227 | Exonic | 100289187 | transmembrane protein 225-like | N/A |
| LOC100289656 | 228 | Exonic | 100289656 | N/A | N/A |
| LOC148696 | 229 | Exonic | 148696 | N/A | N/A |
| LOC158696 | 230 | Exonic | 158696 | N/A | N/A |
| LOC255025 | 231 | Exonic | 255025 | N/A | N/A |
| LOC342346 | 232 | Exonic | N/A | N/A | N/A |
| LOC349408 | 233 | Exonic | N/A | N/A | N/A |
| LOC388387 | 234 | Exonic | 388387 | N/A | N/A |
| LOC400456 | 235 | Exonic | 400456 | N/A | N/A |
| LOC401109 | 236 | Exonic | 401109 | N/A | N/A |
| LOC646278 | 237 | Exonic | 646278 | N/A | N/A |
| LOC729678 | 238 | Exonic | 729678 | N/A | N/A |
| LOC91316 | 239 | Exonic | N/A | N/A | N/A |
| LOC92659 | 240 | Exonic | 92659 | N/A | N/A |
| LRRC33 | 241 | Exonic | 375387 | leucine-rich repeat-containing protein 33 precursor | N/A |

TABLE 3-continued

| GENE NAME | CNV Gene Region | Gene ID # | NCBI Gene ID | Gene Description | RefSeq Summmary |
|---|---|---|---|---|---|
| LRRC45 | Exonic | 242 | 201255 | leucine-rich repeat-containing protein 45 | N/A |
| LYSMD3 | Exonic | 243 | 116068 | lysM and putative peptidoglycan-binding domain-containing protein 3 | N/A |
| MAFG | Exonic | 244 | 4097 | transcription factor MafG | Globin gene expression is regulated through nuclear factor erythroid-2 (NFE2) elements located in enhancer-like locus control regions positioned many kb upstream of alpha- and beta-gene clusters (summarized by Blank et al., 1997 [PubMed 9166829]). NFE2 DNA-binding activity consists of a heterodimer containing a ubiquitous small Maf protein (MafF; MIM 604877; MafG; or MafK, MIM 600197) and the tissue-restricted protein p45 NFE2 (MIM 601490). Both subunits are members of the activator protein-1-like superfamily of basic leucine zipper (bZIP) proteins (see MIM 165160). [supplied by OMIM, March 2010]. Transcript Variant: This variant (2) differs in the 5' UTR compared to variant 1. Both variants 1 and 2 encode the same protein. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| MAN2C1 | Exonic | 245 | 4123 | alpha-mannosidase 2C1 | N/A |
| MAOA | Intronic | 246 | 4128 | amine oxidase [flavin-containing] A | This gene encodes monoamine oxidase A, an enzyme that degrades amine neurotransmitters, such as dopamine, norepinephrine, and serotonin. The protein localizes to the mitochondrial outer membrane. The gene is adjacent to a related gene on the opposite strand of chromosome X. Mutation in this gene results in monoamine oxidase deficiency, or Brunner syndrome. [provided by RefSeq, July 2008]. |
| MAP3K9 | Exonic | 247 | 4293 | mitogen-activated protein kinase kinase kinase 9 | N/A |
| MAPKAPK5 | Exonic | 248 | 8550 | MAP kinase-activated protein kinase 5 isoform 2 | The protein encoded by this gene is a member of the serine/threonine kinase family. In response to cellular stress and proinflammatory cytokines, this kinase is activated through its phosphorylation by MAP kinases including MAPK1/ERK, MAPK14/p38-alpha, and MAPK11/p38-beta. In vitro, this kinase phosphorylates heat shock protein HSP27 at its physiologically relevant sites. Two alternatively spliced transcript variants of this gene encoding distinct isoforms have been reported. [provided by RefSeq, July 2008]. Transcript Variant: This variant (2) contains an extra 6 nt segment in the coding region when compared to variant 1. It encodes an isoform (2) longer by 2 aa, as compared to isoform 1. |
| MAS1 | Exonic | 249 | 4142 | proto-oncogene Mas | The structure of the MAS 1 product indicates that it belongs to the class of receptors that are coupled to GTP-binding proteins and share a conserved structural motif, which is described as a '7-transmembrane segment' following the prediction that these hydrophobic segments form membrane-spanning alpha-helices. The MAS1 protein may be a receptor that, when activated, modulates a |

TABLE 3-continued

| GENE NAME | CNV Gene Region | Gene ID # | NCBI Gene ID | Gene Description | RefSeq Summmary |
|---|---|---|---|---|---|
| MBLAC2 | Exonic | 250 | 153364 | metallo-beta-lactamase domain-containing protein 2 | critical component in a growth-regulating pathway to bring about oncogenic effects. [provided by RefSeq, July 2008].<br>N/A |
| MGAM | Exonic | 251 | 8972 | maltase-glucoamylase, intestinal | This gene encodes maltase-glucoamylase, which is a brush border membrane enzyme that plays a role in the final steps of digestion of starch. The protein has two catalytic sites identical to those of sucrase-isomaltase, but the proteins are only 59% homologous. Both are members of glycosyl hydrolase family 31, which has a variety of substrate specificities. [provided by RefSeq, July 2008]. |
| MICAL3 | Exonic | 252 | 57553 | protein MICAL-3 isoform 3 | N/A |
| MIR1184-1 | Exonic | 253 | 100302111 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR1184-2 | Exonic | 254 | 100422985 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR1184-3 | Exonic | 255 | 100422977 | N/A | microRNAs (miRNAs) are short (20-24 nt) non-coding RNAs that are involved in post-transcriptional regulation of gene expression in multicellular organisms by affecting both the stability and translation of mRNAs. miRNAs are |

TABLE 3-continued

| GENE NAME | CNV Gene ID # | Gene Region | NCBI Gene ID | Gene Description | RefSeq Summmary |
|---|---|---|---|---|---|
| | | | | | transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR125A | 256 | Exonic | 406910 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. Publication Note: This RefSeq record includes a subset of the publications that are available for this gene. Please see the Gene record to access additional publications. |
| MIR1302-1 | 257 | Exonic | 100302227 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' |

TABLE 3-continued

| GENE NAME | CNV Gene ID # | Gene Region | NCBI Gene ID | Gene Description | RefSeq Summary |
|---|---|---|---|---|---|
| MIR1322 | 258 | Exonic | 100302166 | N/A | ends may not be included in the intermediate precursor miRNA produced by Drosha cleavage. |
| MIR1470 | 259 | Exonic | 100302127 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR26B | 260 | Exonic | 407017 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided |

TABLE 3-continued

| GENE NAME | CNV Gene Region | Gene ID # | NCBI Gene ID | Gene Description | RefSeq Summary |
|---|---|---|---|---|---|
| | | | | | by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. Publication Note: This RefSeq record includes a subset of the publications that are available for this gene. Please see the Gene record to access additional publications. |
| MIR3186 | Exonic | 261 | 100422944 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR516B2 | Exonic | 262 | 574485 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR548Y | Exonic | 263 | 100500919 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature |

TABLE 3-continued

| GENE NAME | Gene ID # | CNV Gene Region | NCBI Gene ID | Gene Description | RefSeq Summmary |
|---|---|---|---|---|---|
| | 264 | Exonic | N/A | N/A | miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted primary transcript as defined by miRBase. Some sequence at the 5' and 3' ends may not be included in the intermediate precursor miRNA produced by Drosha cleavage. |
| MIR663 | 265 | Exonic | 407056 | N/A | N/A |
| MIR99B | | | | | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted primary transcript as defined by miRBase. Some sequence at the 5' and 3' ends may not be included in the intermediate precursor miRNA produced by Drosha cleavage. |
| MIRLET7E | 266 | Exonic | 406887 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted primary transcript as defined by miRBase. Some sequence at the 5' and 3' ends may not be included in the intermediate precursor miRNA produced by Drosha cleavage. |
| MITD1 | 267 | Exonic | 129531 | MIT domain-containing protein 1 | N/A |
| MMP25 | 268 | Exonic | 64386 | matrix metalloproteinase-25 preproprotein | Proteins of the matrix metalloproteinase (MMP) family are involved in the breakdown of extracellular matrix in normal physiological processes, such as embryonic development, reproduction, and tissue remodeling, as well as in disease processes, such as arthritis and metastasis. Most MMPs are secreted as |

TABLE 3-continued

| GENE NAME | Gene ID # | CNV Gene Region | NCBI Gene ID | Gene Description | RefSeq Summmary |
|---|---|---|---|---|---|
| | | | | | inactive proproteins which are activated when cleaved by extracellular proteinases. However, the protein encoded by this gene is a member of the membrane-type MMP (MT-MMP) subfamily, attached to the plasma membrane via a glycosylphosphatidyl inositol anchor. In response to bacterial infection or inflammation, the encoded protein is thought to inactivate alpha-1 proteinase inhibitor, a major tissue protectant against proteolytic enzymes released by activated neutrophils, facilitating the transendothelial migration of neutrophils to inflammatory sites. The encoded protein may also play a role in tumor invasion and metastasis through activation of MMP2. The gene has previously been referred to as MMP20 but has been renamed MMP25. [provided by RefSeq, July 2008]. |
| MNS1 | 269 | Exonic | 55329 | meiosis-specific nuclear structural protein 1 | This gene encodes a protein highly similar to the mouse meiosis-specific nuclear structural 1 protein. The mouse protein was shown to be expressed at the pachytene stage during spermatogenesis and may function as a nuclear skeletal protein to regulate nuclear morphology during meiosis. [provided by RefSeq, October 2008]. |
| MR1 | 270 | Exonic | 3140 | major histocompatibility complex, class I-related gene protein isoform 4 precursor | N/A |
| MRPL12 | 271 | Exonic | 6182 | 39S ribosomal protein L12, mitochondrial precursor | Mammalian mitochondrial ribosomal proteins are encoded by nuclear genes and help in protein synthesis within the mitochondrion. Mitochondrial ribosomes (mitoribosomes) consist of a small 28S subunit and a large 39S subunit. They have an estimated 75% protein to rRNA composition compared to prokaryotic ribosomes, where this ratio is reversed. Another difference between mammalian mitoribosomes and prokaryotic ribosomes is that the latter contain a 5S rRNA. Among different species, the proteins comprising the mitoribosome differ greatly in sequence, and sometimes in biochemical properties, which prevents easy recognition by sequence homology. This gene encodes a 39S subunit protein which forms homodimers. In prokaryotic ribosomes, two L7/L12 dimers and one L10 protein form the L8 protein complex. [provided by RefSeq, July 2008]. |
| MRPL30 | 272 | Exonic | 51263 | 39S ribosomal protein L30, mitochondrial precursor | Mammalian mitochondrial ribosomal proteins are encoded by nuclear genes and help in protein synthesis within the mitochondrion. Mitochondrial ribosomes (mitoribosomes) consist of a small 28S subunit and a large 39S subunit. They have an estimated 75% protein to rRNA composition compared to prokaryotic ribosomes, where this ratio is reversed. Another difference between mammalian mitoribosomes and prokaryotic ribosomes is that the latter contain a 5S rRNA. Among different species, the proteins comprising the mitoribosome differ greatly in sequence, and sometimes in biochemical properties, which prevents easy recognition by sequence homology. This gene encodes a 39S subunit protein. Alternative splicing results in multiple transcript variants. Pseudogenes corresponding to this gene are found on chromosomes 6p and 12p. Read-through transcription also exists between this gene and the neighboring upstream lipoyltransferase 1 (LIPT1) gene. [provided by RefSeq, March 2011]. Transcript Variant: This variant (1) represents the longer transcript and encodes the supported protein. Sequence Note: This RefSeq record was created from transcript and genomic sequence data to make the sequence consistent with the |

TABLE 3-continued

| GENE NAME | Gene ID # | CNV Gene Region | NCBI Gene ID | Gene Description | RefSeq Summmary |
|---|---|---|---|---|---|
| MTRNR2L6 | 273 | Exonic | 100463482 | humanin-like protein 6 | reference genome assembly. The genomic coordinates used for the transcript record were based on transcript alignments. |
| MYADML2 | 274 | Exonic | 255275 | myeloid-associated differentiation marker-like protein 2 | N/A |
| MYBL1 | 275 | Exonic | 4603 | myb-related protein A isoform 2 | N/A |
| MYH6 | 276 | Exonic | 4624 | myosin-6 | Cardiac muscle myosin is a hexamer consisting of two heavy chain subunits, two light chain subunits, and two regulatory subunits. This gene encodes the alpha heavy chain subunit of cardiac myosin. The gene is located 4kb downstream of the gene encoding the beta heavy chain subunit of cardiac myosin. Mutations in this gene cause familial hypertrophic cardiomyopathy and atrial septal defect 3. [provided by RefSeq, March 2010]. |
| MYO18B | 277 | Exonic | 84700 | myosin-XVIIIb | The protein encoded by this gene may regulate muscle-specific genes when in the nucleus and may influence intracellular trafficking when in the cytoplasm. The encoded protein functions as a homodimer and may interact with F actin. Mutations in this gene are associated with lung cancer. [provided by RefSeq, July 2008]. |
| N4BP2 | 278 | Exonic | 55728 | NEDD4-binding protein 2 | This gene encodes a protein containing a polynucleotide kinase domain (PNK) near the N-terminal region, and a Small MutS Related (Smr) domain near the C-terminal region. The encoded protein can bind to both B-cell leukemia/lymphoma 3 (BCL-3) and neural precursor cell expressed, developmentally downregulated 4, (Nedd4) proteins. This protein binds and hydrolyzes ATP, may function as a 5'-polynucleotide kinase, and has the capacity to be a ubiquitylation substrate. This protein may play a role in transcription-coupled DNA repair or genetic recombination. [provided by RefSeq, July 2008]. Sequence Note: This RefSeq record was created from transcript and genomic sequence data to make the sequence consistent with the reference genome assembly. The genomic coordinates used for the transcript record were based on transcript alignments. |
| NACAD | 279 | Exonic | 23148 | NAC-alpha domain-containing protein 1 | N/A |
| NAT8 | 280 | Exonic | 9027 | probable N-acetyltransferase 8 | This gene, isolated using the differential display method to detect tissue-specific genes, is specifically expressed in kidney and liver. The encoded protein shows amino acid sequence similarity to N-acetyltransferases. A similar protein in Xenopus affects cell adhesion and gastrulation movements, and may be localized in the secretory pathway. A highly similar paralog is found in a cluster with this gene. [provided by RefSeq, September 2008]. |
| NCRNA00085 | 281 | Exonic | N/A | N/A | N/A |
| NDNL2 | 282 | Exonic | 56160 | melanoma-associated antigen G1 | The protein encoded by this gene is part of the SMC5-6 chromatin reorganizing complex and is a member of the MAGE superfamily. This is an intronless gene. [provided by RefSeq, May 2011]. |
| NDRG1 | 283 | Exonic | 10397 | protein NDRG1 | This gene is a member of the N-myc downregulated gene family which belongs to the alpha/beta hydrolase superfamily. The protein encoded by this gene is a cytoplasmic protein involved in stress responses, hormone responses, cell growth, and differentiation. It is necessary for p53-mediated caspase activation |

TABLE 3-continued

| GENE NAME | Gene ID # | CNV Gene Region | NCBI Gene ID | Gene Description | RefSeq Summmary |
|---|---|---|---|---|---|
| | | | | | and apoptosis. Mutation in this gene has been reported to be causative for hereditary motor and sensory neuropathy-Lom. Multiple alternatively spliced variants, encoding the same protein, have been identified. [provided by RefSeq, September 2008]. Transcript Variant: This variant (2) uses an alternate splice site in the 5' UTR. Both variants 1 and 2 encode the same protein. |
| NEO1 | 284 | Exonic | 4756 | neogenin isoform 1 precursor | This gene encodes a cell surface protein that is a member of the immunoglobulin superfamily. The encoded protein consists of four N-terminal immunoglobulin-like domains, six fibronectin type III domains, a transmembrane domain and a C-terminal internal domain that shares homology with the tumor suppressor candidate gene DCC. This protein may be involved in cell growth and differentiation and in cell-cell adhesion. Defects in this gene are associated with cell proliferation in certain cancers. Alternate splicing results in multiple transcript variants. [provided by RefSeq, February 2010]. Transcript Variant: This variant (1) represents the longest transcript and encodes the longest isoform (1). |
| NFIA | 285 | Exonic | 4774 | nuclear factor 1 A-type isoform 4 | This gene encodes a member of the NF1 (nuclear factor 1) family of transcription factors. Multiple transcript variants encoding different isoforms have been found for this gene. [provided by RefSeq, September 2011]. Transcript Variant: This variant (4) differs in the 5' UTR and coding region compared to variant 1. The resulting protein (isoform 4) has a longer and distinct N-terminus compared to isoform 1. Sequence Note: This RefSeq record was created from transcript and genomic sequence data to make the sequence consistent with the reference genome assembly. The genomic coordinates used for the transcript record were based on transcript alignments. |
| NOTUM | 286 | Exonic | 147111 | protein notum homolog precursor | N/A |
| NPB | 287 | Exonic | 256933 | neuropeptide B preproprotein | Neuropeptide B (NPB) is an endogenous peptide ligand for G protein-coupled receptor-7 (GPR7; MIM 600730). [supplied by OMIM, April 2004]. |
| NPLOC4 | 288 | Exonic | 55666 | nuclear protein localization protein 4 homolog | N/A |
| NRXN1 | 289 | Exonic | 9378 | neurexin-1-beta isoform beta precursor | Neurexins function in the vertebrate nervous system as cell adhesion molecules and receptors. Two neurexin genes are among the largest known in human (NRXN1 and NRXN3). By using alternate promoters, splice sites and exons, predictions of hundreds or even thousands of distinct mRNAs have been made. Most transcripts use the upstream promoter and encode alpha-neurexin isoforms; fewer transcripts are produced from the downstream promoter and encode beta-neurexin isoforms. Alpha-neurexins contain epidermal growth factor-like (EGF-like) sequences and laminin G domains, and they interact with neurexophilins. Beta-neurexins lack EGF-like sequences and contain fewer laminin G domains than alpha-neurexins. The RefSeq Project has decided to create only a few representative transcript variants of the multitude that are possible. [provided by RefSeq, October 2008]. Transcript Variant: This variant (beta) represents a beta neurexin transcript. It is transcribed from a downstream promoter, includes a different segment for its 5' UTR and 5' coding region, and lacks most of the 5' exons present in alpha transcripts, as compared to variant alpha2. The resulting protein (isoform beta) has a shorter and distinct N-terminus when it is compared to isoform alpha2. Sequence Note: The RefSeq transcript and protein were derived from transcript and genomic sequence to |

TABLE 3-continued

| GENE NAME | CNV Gene ID # | CNV Gene Region | NCBI Gene ID | Gene Description | RefSeq Summmary |
|---|---|---|---|---|---|
| NRXN3 | 290 | Exonic | 9369 | neurexin-3-beta isoform 3 precursor | make the sequence consistent with the reference genome assembly. The genomic coordinates used for the transcript record were based on alignments. Neurexins are a family of proteins that function in the vertebrate nervous system as cell adhesion molecules and receptors. They are encoded by several unlinked genes of which two, NRXN1 and NRXN3, are among the largest known human genes. Three of the genes (NRXN1-3) utilize two alternate promoters and include numerous alternatively spliced exons to generate thousands of distinct mRNA transcripts and protein isoforms. The majority of transcripts are produced from the upstream promoter and encode alpha-neurexin isoforms; a much smaller number of transcripts are produced from the downstream promoter and encode beta-neurexin isoforms. The alpha-neurexins contain epidermal growth factor-like (EGF-like) sequences and laminin G domains, and have been shown to interact with neurexophilins. The beta-neurexins lack EGF-like sequences and contain fewer laminin G domains than alpha-neurexins. [provided by RefSeq, July 2008]. Transcript Variant: This variant (3) differs in the 5' UTR and has multiple coding region differences, compared to variant 1. The resulting isoform (3) has a shorter and distinct N-terminus when compared to isoform 1. Publication Note: This RefSeq record includes a subset of the publications that are available for this gene. Please see the Gene record to access additional publications. |
| NSDHL | 291 | Exonic | 50814 | sterol-4-alpha-carboxylate 3-dehydrogenase, decarboxylating | The protein encoded by this gene is localized in the endoplasmic reticulum and is involved in cholesterol biosynthesis. Mutations in this gene are associated with CHILD syndrome, which is a X-linked dominant disorder of lipid metabolism with disturbed cholesterol biosynthesis, and typically lethal in males. Alternatively spliced transcript variants with differing 5' UTR have been found for this gene. [provided by RefSeq, July 2008]. Transcript Variant: This variant (1) represents the more predominant transcript. Transcript variants 1 and 2 encode the same protein. |
| NSF | 292 | Exonic | 4905 | N/A | N/A |
| NUDT17 | 293 | Exonic | 200035 | nucleoside diphosphate-linked moiety X motif 17 | N/A |
| NUP155 | 294 | Exonic | 9631 | nuclear pore complex protein Nup155 isoform 2 | Nucleoporins are the main components of the nuclear pore complex (NPC) of eukaryotic cells. They are involved in the bidirectional trafficking of molecules, especially mRNAs and proteins, between the nucleus and the cytoplasm. The protein encoded by this gene does not contain the typical FG repeat sequences found in most vertebrate nucleoporins. Two protein isoforms are encoded by transcript variants of this gene. [provided by RefSeq, July 2008]. Transcript Variant: This variant (2) uses alternate splicing in the 5' region and a downstream start codon, compared to variant 1. Isoform 2 has a shorter N-terminus, compared to isoform 1. |
| ODZ1 | 295 | Exonic | 10178 | teneurin-1 isoform 3 | The protein encoded by this gene belongs to the tenascin family and teneurin subfamily. It is expressed in the neurons and may function as a cellular signal transducer. Several alternatively spliced transcript variants encoding different isoforms have been found for this gene. [provided by RefSeq, September 2009]. Transcript Variant: This variant (3) lacks an in-frame coding exon compared to variant 1. This results in a shorter isoform (3) missing an internal 7 aa protein segment compared to isoform 1. Sequence Note: This RefSeq record was created from transcript and genomic sequence data to make the sequence |

TABLE 3-continued

| GENE NAME | CNV Gene ID # | CNV Gene Region | NCBI Gene ID | Gene Description | RefSeq Summmary |
|---|---|---|---|---|---|
| | | | | | consistent with the reference genome assembly. The genomic coordinates used for the transcript record were based on transcript alignments. |
| OFD1 | 296 | Exonic | 8481 | oral-facial-digital syndrome 1 protein | This gene is located on the X chromosome and encodes a centrosomal protein. A knockout mouse model has been used to study the effect of mutations in this gene. The mouse gene is also located on the X chromosome, however, unlike the human gene it is not subject to X inactivation. Mutations in this gene are associated with oral-facial-digital syndrome type I and Simpson-Golabi-Behmel syndrome type 2. Many pseudogenes have been identified; a single pseudogene is found on chromosome 5 while as many as fifteen have been described for this gene but the biological validity of these transcripts has not been determined. [provided by RefSeq, July 2008]. |
| OR2T8 | 297 | Exonic | 343172 | olfactory receptor 2T8 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| OR4A5 | 298 | Exonic | 81318 | olfactory receptor 4A5 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. Sequence Note: The RefSeq transcript and protein were derived from genomic sequence to make the sequence consistent with the reference genome assembly. The genomic coordinates used for the transcript record were based on alignments. |
| OR52E4 | 299 | Exonic | 390081 | olfactory receptor 52E4 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| OR52N1 | 300 | Exonic | 79473 | olfactory receptor 52N1 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7- |

TABLE 3-continued

| GENE NAME | CNV Gene Gene ID # Region | NCBI Gene ID | Gene Description | RefSeq Summmary |
|---|---|---|---|---|
| | | | | transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| OR6Y1 | 301 Exonic | 391112 | olfactory receptor 6Y1 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| OSTCL | 302 Exonic | N/A | N/A | N/A |
| OTUD5 | 303 Exonic | 55593 | OTU domain-containing protein 5 isoform b | This gene encodes a member of the OTU (ovarian tumor) domain-containing cysteine protease superfamily. The OTU domain confers deubiquitinase activity and the encoded protein has been shown to suppress the type I interferon-dependent innate immune response by cleaving the polyubiquitin chain from an essential type I interferon adaptor protein. Cleavage results in disassociation of the adaptor protein from a downstream signaling complex and disruption of the type I interferon signaling cascade. Alternatively spliced transcript variants encoding different isoforms have been described. [provided by RefSeq, October 2008]. Transcript Variant: This variant (3) differs in the 3' UTR and lacks an in-frame portion of an internal coding exon, compared to variant 1, resulting in a shorter protein compared to isoform a. Variants 2 and 3 encode the same isoform (b). |
| P4HB | 304 Exonic | 5034 | protein disulfide-isomerase precursor | This gene encodes the beta subunit of prolyl 4-hydroxylase, a highly abundant multifunctional enzyme that belongs to the protein disulfide isomerase family. When present as a tetramer consisting of two alpha and two beta subunits, this enzyme is involved in hydroxylation of prolyl residues in preprocollagen. This enzyme is also a disulfide isomerase containing two thioredoxin domains that catalyze the formation, breakage and rearrangement of disulfide bonds. Other known functions include its ability to act as a chaperone that inhibits aggregation of misfolded proteins in a concentration-dependent manner, its ability to bind thyroid hormone, its role in both the influx and efflux of S-nitrosothiol-bound nitric oxide, and its function as a subunit of the microsomal triglyceride transfer protein complex. [provided by RefSeq, July 2008]. |
| PACSIN3 | 305 Exonic | 29763 | protein kinase C and casein kinase substrate in neurons protein 3 | This gene is a member of the protein kinase C and casein kinase substrate in neurons family. The encoded protein is involved in linking the actin cytoskeleton with vesicle formation. Alternative splicing results in multiple transcript variants. [provided by RefSeq, May 2010]. Transcript Variant: This variant (3) differs in the 5' UTR compared to variant 1. Variants 1, 2 and 3 encode the same protein. |
| PCDH15 | 306 Exonic | 65217 | protocadherin-15 isoform CD1-4 precursor | This gene is a member of the cadherin superfamily. Family members encode integral membrane proteins that mediate calcium-dependent cell-cell adhesion. It plays an essential role in maintenance of normal retinal and cochlear function. |

TABLE 3-continued

| GENE NAME | CNV Gene ID # | Gene Region | NCBI Gene ID | Gene Description | RefSeq Summary |
|---|---|---|---|---|---|
| PCYT2 | 307 | Exonic | 5833 | ethanolamine-phosphate cytidylyltransferase isoform 1 | Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (C) lacks two alternate in-frame exons in the 5' and 3' coding region, compared to variant A. The resulting isoform (CD1-4) lacks a 5-aa segment near the N-terminus and a 2-aa segment near the C-terminus, compared to isoform CD1-1. Publication Note: This RefSeq record includes a subset of the publications that are available for this gene. Please see the Gene record to access additional publications. This gene encodes an enzyme that catalyzes the formation of CDP-ethanolamine from CTP and phosphoethanolamine in the Kennedy pathway of phospholipid synthesis. Alternative splicing results in multiple transcript variants. [provided by RefSeq, May 2010]. Transcript Variant: This variant (1) encodes the longer isoform (1). Sequence Note: This RefSeq record was created from transcript and genomic sequence data to make the sequence consistent with the reference genome assembly. The genomic coordinates used for the transcript record were based on transcript alignments. |
| PDCD6IP | 308 | Exonic | 10015 | programmed cell death 6-interacting protein isoform 2 | This gene encodes a protein thought to participate in programmed cell death. Studies using mouse cells have shown that overexpression of this protein can block apoptosis. In addition, the product of this gene binds to the product of the PDCD6 gene, a protein required for apoptosis, in a calcium-dependent manner. This gene product also binds to endophilins, proteins that regulate membrane shape during endocytosis. Overexpression of this gene product and endophilins results in cytoplasmic vacuolization, which may be partly responsible for the protection against cell death. Several alternatively spliced transcript variants encoding different isoforms have been found for this gene. [provided by RefSeq, June 2009]. Transcript Variant: This variant (2) uses an alternative in-frame acceptor splice site at an internal coding exon compared to variant 1. This results in an isoform (2) 5 aa longer than isoform 1. |
| PDE10A | 309 | Exonic | 10846 | cAMP and cAMP-inhibited cGMP 3',5'-cyclic phosphodiesterase 10A isoform 2 | Various cellular responses are regulated by the second messengers cAMP and cGMP. Phosphodiesterases, such as PDE10A, eliminate cAMP- and cGMP-mediated intracellular signaling by hydrolyzing the cyclic nucleotide to the corresponding nucleoside 5-prime monophosphate (Fujishige et al., 2000 [PubMed 10998054]). [supplied by OMIM, March 2008]. Transcript Variant: This variant (2) has an additional exon in the 5' region, which includes an in-frame AUG start codon, as compared to variant 1. The resulting isoform (2) has an alternate and shorter N-terminus, as compared to isoform 1. |
| PDE6G | 310 | Exonic | 5148 | retinal rod rhodopsin-sensitive cGMP 3',5'-cyclic phosphodiesterase subunit gamma | This gene encodes the gamma subunit of cyclic GMP-phosphodiesterase, which is composed of alpha- and beta-catalytic subunits and two identical, inhibitory gamma subunits. This gene is expressed in rod photoreceptors and functions in the phototransduction signaling cascade. It is also expressed in a variety of other tissues, and has been shown to regulate the c-Src protein kinase and G-protein-coupled receptor kinase 2. Alternative splicing results in multiple transcript variants. [provided by RefSeq, February 2009]. Transcript Variant: This variant (1) represents the longer transcript. |
| PDLIM3 | 311 | Exonic | 27295 | PDZ and LIM domain protein 3 isoform a | The protein encoded by this gene contains a PDZ domain and a LIM domain, indicating that it may be involved in cytoskeletal assembly. In support of this, the encoded protein has been shown to bind the spectrin-like repeats of alpha- |

TABLE 3-continued

| GENE NAME | CNV Gene Region | Gene ID # | NCBI Gene ID | Gene Description | RefSeq Summnary |
|---|---|---|---|---|---|
| | | | | | actinin-2 and to colocalize with alpha-actinin-2 at the Z lines of skeletal muscle. This gene is found near a region of chromosome 4 that has been implicated in facioscapulohumeral muscular dystrophy, but this gene does not appear to be involved in the disease. Two transcript variants encoding different isoforms have been found for this gene. [provided by RefSeq, July 2008]. Transcript Variant: This variant (1) represents the longer transcript and encodes the longer isoform (a). Sequence Note: This RefSeq record was created from transcript and genomic sequence data to make the sequence consistent with the reference genome assembly. The genomic coordinates used for the transcript record were based on transcript alignments. |
| PEBP4 | Exonic | 312 | 157310 | phosphatidylethanol-amine binding protein 4 precursor | The phosphatidylethanolamine (PE)-binding proteins, including PEBP4, are an evolutionarily conserved family of proteins with pivotal biologic functions, such as lipid binding and inhibition of serine proteases (Wang et al., 2004 [PubMed 15302887]). [supplied by OMIM, December 2008]. |
| PEX11B | Exonic | 313 | 8799 | peroxisomal membrane protein 11B isoform 1 | N/A |
| PHF1 | Exonic | 314 | 5252 | PHD finger protein 1 isoform a | This gene encodes a Polycomb group protein. The protein is a component of a histone H3 lysine-27 (H3K27)-specific methyltransferase complex, and functions in transcriptional repression of homeotic genes. The protein is also recruited to double-strand breaks, and reduced protein levels results in X-ray sensitivity and increased homologous recombination. Multiple transcript variants encoding different isoforms have been found for this gene. [provided by RefSeq, May 2009]. Transcript Variant: This variant (1), uses an alternate splice site and lacks an alternate exon in the 3' coding region resulting in a frameshift, compared to variant 2. The resulting isoform (a) has a shorter and distinct C-terminus, compared to isoform b. |
| PIAS3 | Exonic | 315 | 10401 | E3 SUMO-protein ligase PIAS3 | This gene encodes a member of the PIAS [protein inhibitor of activated STAT (signal transducer and activator of transcription)] family of transcriptional modulators. The protein functions as a SUMO (small ubiquitin-like modifier)-E3 ligase which catalyzes the covalent attachment of a SUMO protein to specific target substrates. It directly binds to several transcription factors and either blocks or enhances their activity. Alternatively spliced transcript variants of this gene have been identified, but the full-length nature of some of these variants has not been determined. [provided by RefSeq, July 2008]. |
| PINX1 | Exonic | 316 | 54984 | PIN2/TERF1-interacting telomerase inhibitor 1 | N/A |
| PKD1L2 | Exonic | 317 | 114780 | polycystic kidney disease protein 1-like 2 isoform a precursor | This gene encodes a member of the polycystin protein family. The encoded protein contains 11 transmembrane domains, a latrophilin/CL-1-like GPCR proteolytic site (GPS) domain, and a polycystin-1, lipoxygenase, alpha-toxin (PLAT) domain. This protein may function as a component of cation channel pores. Two transcript variants encoding different isoforms have been found for this gene. [provided by RefSeq, July 2008]. Transcript Variant: This variant (1) represents the longer transcript, and encodes the longer isoform (a). |
| PLA2G15 | Exonic | 318 | 23659 | group XV phospholipase A2 precursor | Lysophospholipases are enzymes that act on biological membranes to regulate the multifunctional lysophospholipids. The protein encoded by this gene hydrolyzes lysophosphatidylcholine to glycerophosphorylcholine and a free |

TABLE 3-continued

| GENE NAME | CNV Gene Region | Gene ID # | NCBI Gene ID | Gene Description | RefSeq Summmary |
|---|---|---|---|---|---|
| PLAA | Exonic | 319 | 9373 | phospholipase A-2-activating protein | fatty acid. This enzyme is present in the plasma and thought to be associated with high-density lipoprotein. A later paper contradicts the function of this gene. It demonstrates that this gene encodes a lysosomal enzyme instead of a lysophospholipase and has both calcium-independent phospholipase A2 and transacylase activities. [provided by RefSeq, July 2008]. |
| PMS2 | Exonic | 320 | 5395 | N/A | This gene is one of the PMS2 gene family members found in clusters on chromosome 7. The product of this gene is involved in DNA mismatch repair. It forms a heterodimer with MLH1 and this complex interacts with other complexes bound to mismatched bases. Mutations in this gene are associated with hereditary nonpolyposis colorectal cancer, Turcot syndrome, and are a cause of supratentorial primitive neuroectodermal tumors. Alternatively spliced transcript variants have been observed for this gene. [provided by RefSeq, July 2008]. Transcript Variant: This variant (2) uses an alternate acceptor splice site at exon 2, resulting in a frame-shift and premature translation termination, rendering the transcript susceptible to nonsense-mediated mRNA decay (NMD). |
| PNKD | Exonic | 321 | 25953 | probable hydrolase PNKD isoform 1 precursor | This gene is thought to play a role in the regulation of myofibrillogenesis. Mutations in this gene have been associated with the movement disorder paroxysmal non-kinesigenic dyskinesia. Alternative splicing results in multiple transcript variants. [provided by RefSeq, March 2010]. Transcript Variant: This variant (1), alternately referred to as the long form (MR-1L), represents the longest transcript and encodes the longest isoform (1). Publication Note: This RefSeq record includes a subset of the publications that are available for this gene. Please see the Gene record to access additional publications. |
| PNLIPRP3 | Exonic | 322 | 119548 | pancreatic lipase-related protein 3 precursor | N/A |
| POLR3C | Exonic | 323 | 10623 | DNA-directed RNA polymerase III subunit RPC3 | N/A |
| POLR3G | Exonic | 324 | 10622 | DNA-directed RNA polymerase III subunit RPC7 | N/A |
| POLR3GL | Exonic | 325 | 84265 | DNA-directed RNA polymerase III subunit RPC7-like | N/A |
| POTEA | Exonic | 326 | 340441 | POTE ankyrin domain family member A isoform 2 | N/A |
| POU5F1P3 | Exonic | 327 | 642559 | N/A | N/A |
| PRDM6 | Exonic | 328 | 93166 | putative histone-lysine N-methyltransferase PRDM6 | N/A |
| PREPL | Exonic | 329 | 9581 | prolyl endopeptidase-like isoform 4 | The protein encoded by this gene belongs to the prolyl oligopeptidase subfamily of serine peptidases. Mutations in this gene have been associated with hypotonia-cystinuria syndrome, also known as the 2p21 deletion syndrome. |

TABLE 3-continued

| GENE NAME | Gene ID # | CNV Gene Region | NCBI Gene ID | Gene Description | RefSeq Summmary |
|---|---|---|---|---|---|
| PRSS38 | 330 | Exonic | 339501 | serine protease 38 precursor | Several alternatively spliced transcript variants encoding either the same or different isoforms have been described for this gene. [provided by RefSeq, January 2010]. Transcript Variant: This variant (7, also known as variant B) contains an alternate exon at the 5' end compared to variant 1, resulting in translation initiation from an in-frame downstream AUG and a shorter isoform (4) compared to isoform 1. Variants 6 and 7 encode the same isoform. Sequence Note: This RefSeq record was created from transcript and genomic sequence data to make the sequence consistent with the reference genome assembly. The genomic coordinates used for the transcript record were based on transcript alignments. |
| PSG3 | 331 | Exonic | 5671 | pregnancy-specific beta-1-glycoprotein 3 precursor | N/A The human pregnancy-specific glycoproteins (PSGs) are a family of proteins that are synthesized in large amounts by placental trophoblasts and released into the maternal circulation during pregnancy. Molecular cloning and analysis of several PSG genes has indicated that the PSGs form a subgroup of the carcinoembryonic antigen (CEA) gene family, which belongs to the immunoglobulin superfamily of genes. Members of the CEA family consist of a single N domain, with structural similarity to the immunoglobulin variable domains, followed by a variable number of immunoglobulin constant-like A and/or B domains. Most PSGs have an arg-gly-asp (RGD) motif, which has been shown to function as an adhesion recognition signal for several integrins, in the N-terminal domain (summary by Teglund et al., 1994 [PubMed 7851896]). For additional general information about the PSG gene family, see PSG1 (MIM 176390). [supplied by OMIM, October 2009]. |
| PSG8 | 332 | Exonic | 440533 | pregnancy-specific beta-1-glycoprotein 8 isoform a precursor | The human pregnancy-specific glycoproteins (PSGs) are a group of molecules that are mainly produced by the placental syncytiotrophoblasts during pregnancy. PSGs comprise a subgroup of the carcinoembryonic antigen (CEA) family, which belongs to the immunoglobulin superfamily. For additional general information about the PSG gene family, see PSG1 (MIM 176390). [supplied by OMIM, October 2009]. Transcript Variant: This variant (1) encodes the longest isoform (a). |
| PSMB1 | 333 | Exonic | 5689 | proteasome subunit beta type-1 | The proteasome is a multicatalytic proteinase complex with a highly ordered ring-shaped 20S core structure. The core structure is composed of 4 rings of 28 non-identical subunits; 2 rings are composed of 7 alpha subunits and 2 rings are composed of 7 beta subunits. Proteasomes are distributed throughout eukaryotic cells at a high concentration and cleave peptides in an ATP/ubiquitin-dependent process in a non-lysosomal pathway. An essential function of a modified proteasome, the immunoproteasome, is the processing of class I MHC peptides. This gene encodes a member of the proteasome B-type family, also known as the T1B family, that is a 20S core beta subunit. This gene is tightly linked to the TBP (TATA-binding protein) gene in human and in mouse, and is transcribed in the opposite orientation in both species. [provided by RefSeq, July 2008]. |
| PYCR1 | 334 | Exonic | 5831 | pyrroline-5-carboxylate reductase 1, mitochondrial isoform 1 | This gene encodes an enzyme that catalyzes the NAD(P)H-dependent conversion of pyrroline-5-carboxylate to proline. This enzyme may also play a physiologic role in the generation of NADP(+) in some cell types. The protein forms a homopolymer and localizes to the mitochondrion. Alternate splicing results in two transcript variants encoding different isoforms. [provided by |

TABLE 3-continued

| GENE NAME | Gene ID # | CNV Gene Region | NCBI Gene ID | Gene Description | RefSeq Summmary |
|---|---|---|---|---|---|
| PYROXD1 | 335 | Exonic | 79912 | pyridine nucleotide-disulfide oxidoreductase domain-containing protein 1 | RefSeq, July 2008]. Transcript Variant: This variant (1) encodes the longer isoform (1) of this protein. N/A |
| RAB11FIP4 | 336 | Exonic | 84440 | rab11 family-interacting protein 4 | Proteins of the large Rab GTPase family (see RAB1A; MIM 179508) have regulatory roles in the formation, targeting, and fusion of intracellular transport vesicles. RAB11FIP4 is one of many proteins that interact with and regulate Rab GTPases (Hales et al., 2001 [PubMed 11495908]). [supplied by OMIM, April 2008]. |
| RAB32 | 337 | Exonic | 10981 | ras-related protein Rab-32 | Small GTP-binding proteins of the RAB family, such as RAB32, play essential roles in vesicle and granule targeting (Bao et al., 2002 [PubMed 11784320]). [supplied by OMIM, August 2009]. Sequence Note: removed 2 bases from the 5' end that did not align to the reference genome assembly. |
| RABEPK | 338 | Exonic | 10244 | rab9 effector protein with kelch motifs isoform b | N/A |
| RAC3 | 339 | Exonic | 5881 | ras-related C3 botulinum toxin substrate 3 | The protein encoded by this gene is a GTPase which belongs to the RAS superfamily of small GTP-binding proteins. Members of this superfamily appear to regulate a diverse array of cellular events, including the control of cell growth, cytoskeletal reorganization, and the activation of protein kinases. [provided by RefSeq, July 2008]. |
| RARRES3 | 340 | Exonic | 5920 | retinoic acid receptor responder protein 3 | Retinoids exert biologic effects such as potent growth inhibitory and cell differentiation activities and are used in the treatment of hyperproliferative dermatological diseases. These effects are mediated by specific nuclear receptor proteins that are members of the steroid and thyroid hormone receptor superfamily of transcriptional regulators. RARRES1, RARRES2, and RARRES3 are genes whose expression is upregulated by the synthetic retinoid tazarotene. RARRES3 is thought act as a tumor suppressor or growth regulator. [provided by RefSeq, July 2008]. |
| RASGEF1A | 341 | Exonic | 221002 | ras-GEF domain-containing family member 1A | N/A |
| RBM8A | 342 | Exonic | 9939 | RNA-binding protein 8A | This gene encodes a protein with a conserved RNA-binding motif. The protein is found predominantly in the nucleus, although it is also present in the cytoplasm. It is preferentially associated with mRNAs produced by splicing, including both nuclear mRNAs and newly exported cytoplasmic mRNAs. It is thought that the protein remains associated with spliced mRNAs as a tag to indicate where introns had been present, thus coupling pre- and post-mRNA splicing events. Previously, it was thought that two genes encode this protein, RBM8A and RBM8B; it is now thought that the RBM8B locus is a pseudogene. Two alternative start codons result in two forms of the protein, and this gene also uses multiple polyadenylation sites. [provided by RefSeq, July 2008]. Sequence Note: This RefSeq record was created from transcript and genomic sequence data to make the sequence consistent with the reference genome |

TABLE 3-continued

| GENE NAME | CNV Gene ID # | Gene Region | NCBI Gene ID | Gene Description | RefSeq Summmary |
|---|---|---|---|---|---|
| RECQL | 343 | Exonic | 5965 | ATP-dependent DNA helicase Q1 | assembly. The genomic coordinates used for the transcript record were based on transcript alignments. The protein encoded by this gene is a member of the RecQ DNA helicase family. DNA helicases are enzymes involved in various types of DNA repair, including mismatch repair, nucleotide excision repair and direct repair. Some members of this family are associated with genetic disorders with predisposition to malignancy and chromosomal instability. The biological function of this helicase has not yet been determined. Two alternatively spliced transcripts, which encode the same isoform but differ in their 5' and 3' UTRs, have been described. [provided by RefSeq, July 2008]. Transcript Variant: This variant (2) lacks a segment of 5' UTR sequence, compared to variant 1. Variants 1 and 2 encode the same protein. |
| RFNG | 344 | Exonic | 5986 | beta-1,3-N-acetylglucosaminyl transferase radical fringe precursor | N/A |
| RGL4 | 345 | Exonic | 266747 | ral-GDS-related protein precursor | N/A |
| RGN | 346 | Exonic | 9104 | regucalcin | The protein encoded by this gene is a highly conserved, calcium-binding protein, that is preferentially expressed in the liver and kidney. It may have an important role in calcium homeostasis. Studies in rat indicate that this protein may also play a role in aging, as it shows age-associated down-regulation. This gene is part of a gene cluster on chromosome Xp11.3-Xp11.23. Alternative splicing results in two transcript variants having different 5' UTRs, but encoding the same protein. [provided by RefSeq, July 2008]. Transcript Variant: This variant (2) has an additional exon in the 5' UTR, compared to transcript variant 1. Both variants encode the same protein. |
| RGS20 | 347 | Exonic | 8601 | regulator of G-protein signaling 20 isoform b | The protein encoded by this gene belongs to the family of regulator of G protein signaling (RGS) proteins, which are regulatory and structural components of G protein-coupled receptor complexes. RGS proteins inhibit signal transduction by increasing the GTPase activity of G protein alpha subunits, thereby driving them into their inactive GDP-bound forms. This protein selectively binds to G(z)-alpha and G(alpha)-i2 subunits, and regulates their signaling activities. Alternatively spliced transcript variants encoding different isoforms have been found for this gene. [provided by RefSeq, September 2011]. Transcript Variant: This variant (2) differs in the 5' UTR and coding sequence compared to variant 1. The resulting isoform (b) has a shorter and distinct N-terminus compared to isoform a. Publication Note: This RefSeq record includes a subset of the publications that are available for this gene. Please see the Gene record to access additional publications. |
| RIIAD1 | 348 | Exonic | 284485 | RIIa domain-containing protein 1 | N/A |
| RIN1 | 349 | Exonic | 9610 | ras and Rab interactor 1 | N/A |
| RNF115 | 350 | Exonic | 27246 | E3 ubiquitin-protein ligase RNF115 | N/A |
| RNF168 | 351 | Exonic | 165918 | E3 ubiquitin-protein ligase | This gene encodes an E3 ubiquitin ligase protein that contains a RING finger, a motif present in a variety of functionally distinct proteins and known to be |

TABLE 3-continued

| GENE NAME | Gene ID # | CNV Gene Region | NCBI Gene ID | Gene Description | RefSeq Summary |
|---|---|---|---|---|---|
| | | | | RNF168 | involved in protein-DNA and protein-protein interactions. The protein is involved in DNA double-strand break (DSB) repair. Mutations in this gene result in Riddle syndrome. [provided by RefSeq, September 2011]. Sequence Note: This RefSeq record was created from transcript and genomic sequence data to make the sequence consistent with the reference genome assembly. The genomic coordinates used for the transcript record were based on transcript alignments. |
| RPSAP58 | 352 | Exonic | 388524 | N/A | N/A |
| SELS | 353 | Exonic | 55829 | selenoprotein S | This gene encodes a selenoprotein, which contains a selenocysteine (Sec) residue at its active site. The selenocysteine is encoded by the UGA codon that normally signals translation termination. The 3' UTR of selenoprotein genes have a common stem-loop structure, the sec insertion sequence (SECIS), that is necessary for the recognition of UGA as a Sec codon rather than as a stop signal. Studies suggest that this protein may regulate cytokine production, and thus play a key role in the control of the inflammatory response. Two alternatively spliced transcript variants encoding the same protein have been found for this gene. [provided by RefSeq, July 2008]. Transcript Variant: This variant (1) represents the longer transcript. Transcript variants 1 and 2 encode the same protein. |
| SEPT9 | 354 | Exonic | 10801 | septin-9 isoform f | This gene is a member of the septin family involved in cytokinesis and cell cycle control. This gene is a candidate for the ovarian tumor suppressor gene. Mutations in this gene cause hereditary neuralgic amyotrophy, also known as neuritis with brachial predilection. A chromosomal translocation involving this gene on chromosome 17 and the MLL gene on chromosome 11 results in acute myelomonocytic leukemia. Multiple alternatively spliced transcript variants encoding different isoforms have been described. [provided by RefSeq, March 2009]. Transcript Variant: This variant (7) lacks three 5' exon, but has an alternate 5' exon, which results in a downstream AUG start codon, as compared to variant 1. The resulting isoform (f) has a much shorter N-terminus, as compared to isoform a. Publication Note: This RefSeq record includes a subset of the publications that are available for this gene. Please see the Gene record to access additional publications. |
| SESTD1 | 355 | Exonic | 91404 | SEC14 domain and spectrin repeat-containing protein 1 | N/A |
| SGK1 | 356 | Exonic | 6446 | serine/threonine-protein kinase Sgk1 isoform 1 | This gene encodes a serine/threonine protein kinase that plays an important role in cellular stress response. This kinase activates certain potassium, sodium, and chloride channels, suggesting an involvement in the regulation of processes such as cell survival, neuronal excitability, and renal sodium excretion. High levels of expression of this gene may contribute to conditions such as hypertension and diabetic nephropathy. Several alternatively spliced transcript variants encoding different isoforms have been noted for this gene. [provided by RefSeq, January 2009]. Transcript Variant: This variant (1) represents the predominant transcript and encodes the shortest isoform (1). |
| SGK196 | 357 | Exonic | 84197 | protein kinase-like protein SgK196 | N/A |
| SHANK2 | 358 | Exonic | 22941 | SH3 and multiple ankyrin repeat domains protein 2 | This gene encodes a protein that is a member of the Shank family of synaptic proteins that may function as molecular scaffolds in the postsynaptic density (PSD). Shank proteins contain multiple domains for protein-protein interaction, |

TABLE 3-continued

| GENE NAME | CNV Gene ID # | Gene Region | NCBI Gene ID | Gene Description | RefSeq Summmary |
|---|---|---|---|---|---|
| | | | | isoform 2 | including ankyrin repeats, an SH3 domain, a PSD-95/Dlg/ZO-1 domain, a sterile alpha motif domain, and a proline-rich region. This particular family member contains a PDZ domain, a consensus sequence for cortactin SH3 domain-binding peptides and a sterile alpha motif. The alternative splicing demonstrated in Shank genes has been suggested as a mechanism for regulating the molecular structure of Shank and the spectrum of Shank-interacting proteins in the PSDs of adult and developing brain. Two alternative splice variants, encoding distinct isoforms, are reported. Additional splice variants exist but their full-length nature has not been determined. [provided by RefSeq, July 2008]. Transcript Variant: This variant (2) represents use of a putative alternate promoter and 5′ UTR, and uses an alternate start codon, compared to variant 1. The resulting isoform (2) has a substantially shorter and distinct N-terminus, compared to isoform 1. |
| SIN3A | 359 | Exonic | 25942 | paired amphipathic helix protein Sin3a | The protein encoded by this gene is a transcriptional regulatory protein. It contains paired amphipathic helix (PAH) domains, which are important for protein-protein interactions and may mediate repression by the Mad-Max complex. [provided by RefSeq, July 2008]. Transcript Variant: This variant (2) differs in the 5′ UTR compared to variant 1. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| SIRT7 | 360 | Exonic | 51547 | NAD-dependent deacetylase sirtuin-7 | This gene encodes a member of the sirtuin family of proteins, homologs to the yeast Sir2 protein. Members of the sirtuin family are characterized by a sirtuin core domain and grouped into four classes. The functions of human sirtuins have not yet been determined; however, yeast sirtuin proteins are known to regulate epigenetic gene silencing and suppress recombination of rDNA. Studies suggest that the human sirtuins may function as intracellular regulatory proteins with mono-ADP-ribosyltransferase activity. The protein encoded by this gene is included in class IV of the sirtuin family. [provided by RefSeq, July 2008]. |
| SLC11A1 | 361 | Exonic | 6556 | natural resistance-associated macrophage protein 1 | This gene is a member of the solute carrier family 11 (proton-coupled divalent metal ion transporters) family and encodes a multi-pass membrane protein. The protein functions as a divalent transition metal (iron and manganese) transporter involved in iron metabolism and host resistance to certain pathogens. Mutations in this gene have been associated with susceptibility to infectious diseases such as tuberculosis and leprosy, and inflammatory diseases such as rheumatoid arthritis and Crohn disease. Alternatively spliced variants that encode different protein isoforms have been described but the full-length nature of only one has been determined. [provided by RefSeq, July 2008]. Publication Note: This RefSeq record includes a subset of the publications that are available for this gene. Please see the Gene record to access additional publications. |
| SLC16A3 | 362 | Exonic | 9123 | monocarboxylate transporter 4 | Lactic acid and pyruvate transport across plasma membranes is catalyzed by members of the proton-linked monocarboxylate transporter (MCT) family, which has been designated solute carrier family-16. Each MCT appears to have slightly different substrate and inhibitor specificities and transport kinetics, which are related to the metabolic requirements of the tissues in which it is found. The MCTs, which include MCT1 (SLC16A1; MIM 600682) and MCT2 (SLC16A7; MIM 603654), are characterized by 12 predicted transmembrane domains (Price et al., 1998 [PubMed 9425115]). [supplied by OMIM, March |

TABLE 3-continued

| GENE NAME | Gene ID # | CNV Gene Region | NCBI Gene ID | Gene Description | RefSeq Summmary |
|---|---|---|---|---|---|
| SLC24A2 | 363 | Exonic | 25769 | sodium/potassium/ calcium exchanger 2 isoform 2 | 2008]. Transcript Variant: This variant (6) differs in the 5' UTR compared to variant 1. Variants 1, 2, 3, 4, 5 and 6 encode the same protein. This gene encodes a member of the calcium/cation antiporter superfamily of transport proteins. The encoded protein belongs to the SLC24 branch of exchangers, which can mediate the extrusion of one Ca2+ ion and one K+ ion in exchange for four Na+ ions. This family member is a retinal cone/brain exchanger that can mediate a light-induced decrease in free Ca2+ concentration. This protein may also play a neuroprotective role during ischemic brain injury. Alternative splicing results in multiple transcript variants. [provided by RefSeq, August 2011]. Transcript Variant: This variant (2) lacks an alternate in-frame exon in the central coding region, compared to variant 1, resulting in an isoform (2) that is shorter than isoform 1. Sequence Note: This RefSeq record was created from transcript and genomic sequence data to make the sequence consistent with the reference genome assembly. The genomic coordinates used for the transcript record were based on transcript alignments. |
| SLC25A10 | 364 | Exonic | 1468 | mitochondrial dicarboxylate carrier | The dicarboxylate carrier catalyzes the transport of dicarboxylates such as malate and succinate across the mitochondrial membrane in exchange for phosphate, sulfate, and thiosulfate, thus supplying substrates for the Krebs cycle, gluconeogenesis, urea synthesis, and sulfur metabolism. [supplied by OMIM, July 2002]. |
| SLC25A29 | 365 | Exonic | 123096 | mitochondrial carnitine/acylcarnitine carrier protein CACL | N/A |
| SLC26A6 | 366 | Exonic | 65010 | solute carrier family 26 member 6 isoform 4 | This gene belongs to the solute carrier 26 family, whose members encode anion transporter proteins. This particular family member encodes a protein involved in transporting chloride, oxalate, sulfate and bicarbonate. Several alternatively spliced transcript variants of this gene, encoding distinct isoforms, have been described, but the full-length nature of some of these variants has not been determined. [provided by RefSeq, July 2008]. Transcript Variant: This variant (4), also known as S + Q, contains a distinct 5' UTR and lacks an in-frame portion of the 5' coding region, compared to variant 1. The resulting isoform (4) has a shorter N-terminus when compared to isoform 1. |
| SLC27A6 | 367 | Exonic | 28965 | long-chain fatty acid transport protein 6 | This gene encodes a member of the fatty acid transport protein family (FATP). FATPs are involved in the uptake of long-chain fatty acids and have unique expression patterns. Alternatively spliced transcript variants encoding the same protein have been found for this gene. [provided by RefSeq, July 2008]. Transcript Variant: This variant (2) has an additional segment in the 5' UTR and encodes the same protein, as compared to variant 1. |
| SLC38A6 | 368 | Exonic | 145389 | probable sodium-coupled neutral amino acid transporter 6 isoform 1 | N/A |
| SLC5A10 | 369 | Exonic | 125206 | sodium/glucose cotransporter 5 isoform 2 | N/A |
| SLC7A3 | 370 | Exonic | 84889 | cationic amino acid transporter 3 | This gene encodes a member of the solute carrier family 7. The encoded protein is a sodium-independent cationic amino acid transporter. Alternate splicing |

TABLE 3-continued

| GENE NAME | CNV Gene Region | Gene ID # | NCBI Gene ID | Gene Description | RefSeq Summmary |
|---|---|---|---|---|---|
| SLCO1B3 | Exonic | 371 | 28234 | solute carrier organic anion transporter family member 1B3 | results in multiple transcripts that encoded the same protein. [provided by RefSeq, May 2010]. Transcript Variant: This variant (2) differs in the 5' UTR compared to variant 1. Both variants 1 and 2 encode the same protein. SLCO1B3 belongs to the organic anion transporter (OATP) family. OATPs are involved in the membrane transport of bile acids, conjugated steroids, thyroid hormone, eicosanoids, peptides, and numerous drugs in many tissues (Mikkaichi et al., 2004 [PubMed 14993604]). [supplied by OMIM, April 2010]. |
| SLIT2 | Exonic | 372 | 9353 | slit homolog 2 protein precursor | N/A |
| SNORD32B | Exonic | 373 | 692092 | N/A | N/A |
| SNUPN | Exonic | 374 | 10073 | snurportin-1 | The nuclear import of the spliceosomal snRNPs U1, U2, U4 and U5, is dependent on the presence of a complex nuclear localization signal. The latter is composed of the 5'-2,2,7-terminal trimethylguanosine (m3G) cap structure of the U snRNA and the Sm core domain. The protein encoded by this gene interacts specifically with m3G-cap and functions as an snRNP-specific nuclear import receptor. Alternatively spliced transcript variants encoding the same protein have been identified for this gene. [provided by RefSeq, July 2008]. Transcript Variant: This variant (3) differs in the 5' UTR, compared to variant 1. Variants 1, 2 and 3 encode the same protein. |
| SNX16 | Exonic | 375 | 64089 | sorting nexin-16 isoform a | This gene encodes a member of the sorting nexin family. Members of this family contain a phox (PX) domain, which is a phosphoinositide binding domain, and are involved in intracellular trafficking. The function of this protein has not been determined. This gene results in three transcript variants encoding two distinct isoforms. [provided by RefSeq, July 2008]. Transcript Variant: This variant (1) encodes the longest isoform a. Both transcript variants 1 and 2 encode isoform a. |
| SNX33 | Exonic | 376 | 257364 | sorting nexin-33 | N/A |
| SOAT1 | Exonic | 377 | 6646 | sterol O-acyltransferase 1 isoform 1 | The protein encoded by this gene belongs to the acyltransferase family. It is located in the endoplasmic reticulum, and catalyzes the formation of fatty acid-cholesterol esters. This gene has been implicated in the formation of beta-amyloid and atherosclerotic plaques by controlling the equilibrium between free cholesterol and cytoplasmic cholesteryl esters. Alternatively spliced transcript variants have been found for this gene. [provided by RefSeq, November 2011]. Transcript Variant: This variant (1) represents the predominant transcript, and encodes the longest isoform (1). Sequence Note: This RefSeq record was created from transcript and genomic sequence data to make the sequence consistent with the reference genome assembly. The genomic coordinates used for the transcript record were based on transcript alignments. |
| SPAG16 | Exonic | 378 | 79582 | sperm-associated antigen 16 protein isoform 2 | Cilia and flagella are comprised of a microtubular backbone, the axoneme, which is organized by the basal body and surrounded by plasma membrane. SPAG16 encodes 2 major proteins that associate with the axoneme of sperm tail and the nucleus of postmeiotic germ cells, respectively (Zhang et al., 2007 [PubMed 17699735]). [supplied by OMIM, July 2008]. |
| SPECC1 | Exonic | 379 | 92521 | cytospin-B isoform 1 | The protein encoded by this gene belongs to the cytospin-A family. It is localized in the nucleus, and highly expressed in testis and some cancer cell lines. A chromosomal translocation involving this gene and platelet-derived growth factor receptor, beta gene (PDGFRB) may be a cause of juvenile myelomonocytic leukemia. Alternatively spliced transcript variants encoding different isoforms have been described for this gene. [provided by RefSeq, August |

TABLE 3-continued

| GENE NAME | Gene ID # | CNV Gene Region | NCBI Gene ID | Gene Description | RefSeq Summmary |
|---|---|---|---|---|---|
| SRL | 380 | Exonic | 6345 | sarcalumenin precursor | 2011]. Transcript Variant: This variant (6) contains an alternate 5' terminal non-coding exon compared to variant 1. Variants 1 and 6 encode the same isoform (1). |
| ST6GAL2 | 381 | Exonic | 84620 | beta-galactoside alpha-2,6-sialyltransferase 2 isoform b | N/A Sialyltransferases, such as ST6GAL2 (EC 2.4.99.1), are type II transmembrane proteins that catalyze the transfer of sialic acid from CMP-sialic acid to an acceptor carbohydrate, usually to the terminal ends of carbohydrate chains. [supplied by OMIM, March 2008]. Transcript Variant: This variant (2) differs in the 3' UTR and 3' coding region, compared to variant 1. The resulting isoform (b) has a distinct C-terminus and is shorter than isoform a. |
| STARD3 | 382 | Exonic | 10948 | stAR-related lipid transfer protein 3 isoform 3 | This gene encodes a member of a subfamily of lipid trafficking proteins that are characterized by a C-terminal steroidogenic acute regulatory domain and an N-terminal metastatic lymph node 64 domain. The encoded protein localizes to the membranes of late endosomes and may be involved in exporting cholesterol. Alternative splicing results in multiple transcript variants. [provided by RefSeq, October 2009]. Transcript Variant: This variant (3) lacks an exon in the coding region, compared to variant 1. The encoded isoform (3) is shorter, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| STAT3 | 383 | Exonic | 6774 | signal transducer and activator of transcription 3 isoform 3 | The protein encoded by this gene is a member of the STAT protein family. In response to cytokines and growth factors, STAT family members are phosphorylated by the receptor associated kinases, and then form homo- or heterodimers that translocate to the cell nucleus where they act as transcription activators. This protein is activated through phosphorylation in response to various cytokines and growth factors including IFNs, EGF, IL5, IL6, HGF, LIF and BMP2. This protein mediates the expression of a variety of genes in response to cell stimuli, and thus plays a key role in many cellular processes such as cell growth and apoptosis. The small GTPase Rac1 has been shown to bind and regulate the activity of this protein. PIAS3 protein is a specific inhibitor of this protein. Three alternatively spliced transcript variants encoding distinct isoforms have been described. [provided by RefSeq, July 2008]. Transcript Variant: This variant (3), also called STAT3B or STAT3beta, lacks a segment in the coding region resulting in an early termination codon, compared to variant 1. Variant 3 encodes isoform 3, which has a shorter and distinct C-terminus compared to isoform 1. |
| STIL | 384 | Exonic | 6491 | SCL-interrupting locus protein isoform 1 | This gene encodes a cytoplasmic protein implicated in regulation of the mitotic spindle checkpoint, a regulatory pathway that monitors chromosome segregation during cell division to ensure the proper distribution of chromosomes to daughter cells. The protein is phosphorylated in mitosis and in response to activation of the spindle checkpoint, and disappears when cells transition to G1 phase. It interacts with a mitotic regulator, and its expression is required to efficiently activate the spindle checkpoint. It is proposed to regulate Cdc2 kinase activity during spindle checkpoint arrest. Chromosomal deletions that fuse this gene and the adjacent locus commonly occur in T cell leukemias, and are |

TABLE 3-continued

| GENE NAME | CNV Gene ID # | Gene Region | NCBI Gene ID | Gene Description | RefSeq Summmary |
|---|---|---|---|---|---|
| STON1 | 385 | Exonic | 11037 | stonin-1 | thought to arise through illegitimate V-(D)-J recombination events. Multiple transcript variants encoding different isoforms have been found for this gene. [provided by RefSeq, July 2008]. Transcript Variant: This variant (1) represents the longer transcript and encodes the longer isoform (1). Endocytosis of cell surface proteins is mediated by a complex molecular machinery that assembles on the inner surface of the plasma membrane. This gene encodes one of two human homologs of the Drosophila melanogaster stoned B protein. This protein is related to components of the endocytic machinery and exhibits a modular structure consisting of an N-terminal proline-rich domain, a central region of homology specific to the human stoned B-like proteins, and a C-terminal region homologous to the mu subunits of adaptor protein (AP) complexes. Read-through transcription of this gene into the neighboring downstream gene, which encodes TFIIA-alpha/beta-like factor, generates a transcript (SALF), which encodes a fusion protein comprised of sequence sharing identity with each individual gene product. Alternative splicing results in multiple transcript variants. [provided by RefSeq, October 2010]. Transcript Variant: This variant (1) represents the longer transcript. Both variants 1 and 2 encode the same protein. Sequence Note: This RefSeq record was created from transcript and genomic sequence data to make the sequence consistent with the reference genome assembly. The genomic coordinates used for the transcript record were based on transcript alignments. |
| STON1-GTF2A1L | 386 | Exonic | 286749 | STON1-GTF2A1L protein isoform 3 | STON1-GTF2A1L mRNAs are infrequent but naturally occurring read-through products of the neighboring STON1 and GTF2A1L genes. These transcripts encode fusion proteins composed of the vast majority of each of the individual elements, stonin 1 and general transcription factor IIA, 1-like. Alternative splicing results in multiple transcript variants. The significance of these read-through variants and the function of the resulting protein products have not yet been determined. [provided by RefSeq, October 2010]. Transcript Variant: This variant (3) lacks two alternate exons, resulting in a loss of an in-frame segment in the central coding region, compared to variant 1. The encoded isoform (3) is shorter than isoform 1. The 5′ UTR is incomplete due to a lack of 5′-complete transcript support for this variant and the presence of splicing ambiguity further upstream. Sequence Note: This RefSeq record was created from transcript and genomic sequence data to make the sequence consistent with the reference genome assembly. The genomic coordinates used for the transcript record were based on transcript alignments. |
| STRA13 | 387 | Exonic | 201254 | centromere protein X | N/A |
| STX6 | 388 | Exonic | 10228 | syntaxin-6 | N/A |
| SYK | 389 | Exonic | 6850 | tyrosine-protein kinase SYK isoform 2 | This gene encodes a member of the family of non-receptor type Tyr protein kinases. This protein is widely expressed in hematopoietic cells and is involved in coupling activated immunoreceptors to downstream signaling events that mediate diverse cellular responses, including proliferation, differentiation, and phagocytosis. It is thought to be a modulator of epithelial cell growth and a potential tumour suppressor in human breast carcinomas. Alternatively spliced transcript variants encoding different isoforms have been found for this gene. [provided by RefSeq, March 2010]. Transcript Variant: This variant (4) contains an alternate 5′ terminal exon and lacks an in-frame coding exon compared to variant 1. The former introduces an upstream open reading frame (uORF) with a weak Kozak signal, making translation of the downstream primary ORF (with a |

TABLE 3-continued

| GENE NAME | CNV Gene Region | Gene ID # | NCBI Gene ID | Gene Description | RefSeq Summmary |
|---|---|---|---|---|---|
| SYNGAP1 | Exonic | 390 | 8831 | ras GTPase-activating protein SynGAP | strong Kozak signal) encoding isoform 2 likely by leaky scanning or re-initiation. Variants 2 and 4 encode the same isoform. Sequence Note: This RefSeq record was created from transcript and genomic sequence data to make the sequence consistent with the reference genome assembly. The genomic coordinates used for the transcript record were based on transcript alignments. The protein encoded by this gene is a major component of the postsynaptic density (PSD), a group of proteins found associated with NMDA receptors at synapses. The encoded protein is phosphorylated by calmodulin-dependent protein kinase II and dephosphorylated by NMDA receptor activation. Defects in this gene are a cause of mental retardation autosomal dominant type 5 (MRD5). [provided by RefSeq, December 2009]. Publication Note: This RefSeq record includes a subset of the publications that are available for this gene. Please see the Gene record to access additional publications. |
| T | Exonic | 391 | 6862 | brachyury protein | The protein encoded by this gene is an embryonic nuclear transcription factor that binds to a specific DNA element, the palindromic T-site. It binds through a region in its N-terminus, called the T-box, and effects transcription of genes required for mesoderm formation and differentiation. The protein is localized to notochord-derived cells. [provided by RefSeq, July 2008]. |
| TAS1R2 | Exonic | 392 | 80834 | taste receptor type 1 member 2 precursor | N/A |
| TBCE | Exonic | 393 | 6905 | tubulin-specific chaperone E | Cofactor E is one of four proteins (cofactors A, D, E, and C) involved in the pathway leading to correctly folded beta-tubulin from folding intermediates. Cofactors A and D are believed to play a role in capturing and stabilizing beta-tubulin intermediates in a quasi-native confirmation. Cofactor E binds to the cofactor D/beta-tubulin complex; interaction with cofactor C then causes the release of beta-tubulin polypeptides that are committed to the native state. Two transcript variants encoding the same protein have been found for this gene. [provided by RefSeq, July 2008]. Transcript Variant: This variant (1) represents the longer transcript. Variants 1 and 2 both encode the same protein. Publication Note: This RefSeq record includes a subset of the publications that are available for this gene. Please see the Gene record to access additional publications. |
| TBCK | Exonic | 394 | 93627 | TBC domain-containing protein kinase-like protein isoform c | N/A |
| TCTEX1D2 | Exonic | 395 | 255758 | tctex1 domain-containing protein 2 | N/A |
| TEKT1 | Exonic | 396 | 83659 | tektin-1 | This gene product belongs to the tektin family of proteins. Tektins comprise a family of filament-forming proteins that are coassembled with tubulins to form ciliary and flagellar microtubules. This gene is predominantly expressed in the testis and in mouse, tektin 1 mRNA was localized to the spermatocytes and round spermatids in the seminiferous tubules, indicating that it may play a role in spermatogenesis. [provided by RefSeq, July 2008]. |
| TEX9 | Exonic | 397 | 374618 | testis-expressed sequence 9 protein | N/A |
| TFB2M | Exonic | 398 | 64216 | dimethyladenosine transferase 2, mitochondrial | N/A |

TABLE 3-continued

| GENE NAME | CNV Gene ID # | CNV Gene Region | NCBI Gene ID | Gene Description | RefSeq Summmary |
|---|---|---|---|---|---|
| TFRC | 399 | Exonic | 7037 | transferrin receptor protein 1 | N/A |
| TGFB1I1 | 400 | Exonic | 7041 | transforming growth factor beta-1-induced transcript 1 protein isoform 2 | This gene encodes a coactivator of the androgen receptor, a transcription factor which is activated by androgen and has a key role in male sexual differentiation. The encoded protein is thought to regulate androgen receptor activity and may have a role to play in the treatment of prostate cancer. Multiple transcript variants encoding different isoforms have been found for this gene. [provided by RefSeq, September 2009]. Transcript Variant: This variant (3) differs in the 5' UTR and coding region, and initiates translation at an alternate start codon compared to variant 1. The encoded isoform (2) has a distinct N-terminus and is shorter than isoform 1. Variants 2 and 3 encode the same protein. Publication Note: This RefSeq record includes a subset of the publications that are available for this gene. Please see the Gene record to access additional publications. |
| TGFBR3 | 401 | Exonic | 7049 | transforming growth factor beta receptor type 3 isoform b precursor | This locus encodes the transforming growth factor (TGF)-beta type III receptor. The encoded receptor is a membrane proteoglycan that often functions as a co-receptor with other TGF-beta receptor superfamily members. Ectodomain shedding produces soluble TGFBR3, which may inhibit TGFB signaling. Decreased expression of this receptor has been observed in various cancers. Alternatively spliced transcript variants encoding different isoforms have been identified for this gene. [provided by RefSeq, September 2010]. Transcript Variant: This variant (2) uses an alternate in-frame splice site in the middle portion of the coding region, compared to variant 1. This results in a shorter protein (isoform b), compared to isoform a. Both variants 2 and 3 encode the same isoform (b). Sequence Note: This RefSeq record was created from transcript and genomic sequence data to make the sequence consistent with the reference genome assembly. The genomic coordinates used for the transcript record were based on transcript alignments. |
| THOC4 | 402 | Exonic | 10189 | THO complex subunit 4 | The protein encoded by this gene is a heat stable, nuclear protein and functions as a molecular chaperone. It is thought to regulate dimerization, DNA binding, and transcriptional activity of basic region-leucine zipper (bZIP) proteins. [provided by RefSeq, July 2008]. |
| TIAM2 | 403 | Exonic | 26230 | T-lymphoma invasion and metastasis-inducing protein 2 isoform b | This gene encodes a guanine nucleotide exchange factor. A highly similar mouse protein specifically activates ras-related C3 botulinum substrate 1, converting this Rho-like guanosine triphosphatase (GTPase) from a guanosine diphosphate-bound inactive state to a guanosine triphosphate-bound active state. The encoded protein may play a role in neural cell development. Alternatively spliced transcript variants encoding different isoforms have been described. [provided by RefSeq, July 2008]. Transcript Variant: This variant (2) uses an alternate 5' exon compared to variant 1. The resulting isoform (b) is shorter at the N-terminus compared to isoform a. |
| TLR8 | 404 | Exonic | 51311 | toll-like receptor 8 precursor | The protein encoded by this gene is a member of the Toll-like receptor (TLR) family which plays a fundamental role in pathogen recognition and activation of innate immunity. TLRs are highly conserved from Drosophila to humans and share structural and functional similarities. They recognize pathogen-associated molecular patterns (PAMPs) that are expressed on infectious agents, and mediate the production of cytokines necessary for the development of effective immunity. The various TLRs exhibit different patterns of expression. This gene is predominantly expressed in lung and peripheral blood leukocytes, and lies in close proximity to another family member, TLR7, on chromosome X. [provided |

TABLE 3-continued

| GENE NAME | Gene ID # | CNV Gene Region | NCBI Gene ID | Gene Description | RefSeq Summmary |
|---|---|---|---|---|---|
| TM4SF19 | 405 | Exonic | 116211 | transmembrane 4 L6 family member 19 isoform 3 | by RefSeq, July 2008]. Sequence Note: The RefSeq transcript and protein were derived from genomic sequence to make the sequence consistent with the reference genome assembly. The genomic coordinates used for the transcript record were based on alignments. |
| TM4SF19-TCTEX1D2 | 406 | Exonic | 100534611 | N/A | N/A |
| TMBIM1 | 407 | Exonic | 64114 | transmembrane BAX inhibitor motif-containing protein 1 | This locus represents naturally occurring read-through transcription between the neighboring transmembrane 4 L six family member 19 (TM4SF19) and Tctex1 domain containing 2 (TCTEX1D2) genes on chromosome 3. The read-through transcript is a candidate for nonsense-mediated mRNA decay (NMD), and is thus not expected to produce a protein product. [provided by RefSeq, March 2011].<br>N/A |
| TMEM231 | 408 | Exonic | 79583 | transmembrane protein 231 isoform 3 | N/A |
| TMEM89 | 409 | Exonic | 440955 | transmembrane protein 89 precursor | N/A |
| TMLHE | 410 | Exonic | 55217 | trimethyllysine dioxygenase, mitochondrial isoform 2 precursor | This gene encodes the protein trimethyllysine dioxygenase which is the first enzyme in the carnitine biosynthesis pathway. Carnitine play an essential role in the transport of activated fatty acids across the inner mitochondrial membrane. The encoded protein converts trimethyllysine into hydroxytrimethyllysine. A pseudogene of this gene is found on chromosome X. Alternate splicing results in multiple transcript variants. [provided by RefSeq, May 2010]. Transcript Variant: This variant (2) differs in the 3' UTR and coding region differences, compared to variant 1. The resulting protein (isoform 2) has a distinct C-terminus and is shorter than isoform 1. |
| TPO | 411 | Exonic | 7173 | thyroid peroxidase isoform b precursor | This gene encodes a membrane-bound glycoprotein. The encoded protein acts as an enzyme and plays a central role in thyroid gland function. The protein functions in the iodination of tyrosine residues in thyroglobulin and phenoxy-ester formation between pairs of iodinated tyrosines to generate the thyroid hormones, thyroxine and triiodothyronine. Mutations in this gene are associated with several disorders of thyroid hormonogenesis, including congenital hypothyroidism, congenital goiter, and thyroid hormone organification defect IIA. Multiple transcript variants encoding distinct isoforms have been identified for this gene, but the full-length nature of some variants has not been determined. [provided by RefSeq, May 2011]. Transcript Variant: This variant (7) lacks a segment in the 5' UTR and an in-frame exon in the central coding region, compared to variant 1, resulting in an isoform (b, also known as TPO2) that is shorter than isoform a. |
| TRAF3 | 412 | Exonic | 7187 | TNF receptor-associated factor 3 isoform 3 | The protein encoded by this gene is a member of the TNF receptor associated factor (TRAF) protein family. TRAF proteins associate with, and mediate the signal transduction from, members of the TNF receptor (TNFR) superfamily. This protein participates in the signal transduction of CD40, a TNFR family member important for the activation of the immune response. This protein is |

TABLE 3-continued

| GENE NAME | Gene ID # | CNV Gene Region | NCBI Gene ID | Gene Description | RefSeq Summmary |
|---|---|---|---|---|---|
| TRIM32 | 413 | Exonic | 22954 | E3 ubiquitin-protein ligase TRIM32 | found to be a critical component of the lymphotoxin-beta receptor (LTbetaR) signaling complex, which induces NF-kappaB activation and cell death initiated by LTbeta ligation. Epstein-Barr virus encoded latent infection membrane protein-1 (LMP1) can interact with this and several other members of the TRAF family, which may be essential for the oncogenic effects of LMP1. Several alternatively spliced transcript variants encoding three distinct isoforms have been reported. [provided by RefSeq, December 2010]. Transcript Variant: This variant (4) differs in the 5' UTR and lacks an in-frame coding segment compared to variant 1. The resulting isoform (2) lacks an internal region as compared to isoform 1. Sequence Note: This RefSeq record was created from transcript and genomic sequence data to make the sequence consistent with the reference genome assembly. The genomic coordinates used for the transcript record were based on transcript alignments.<br>The protein encoded by this gene is a member of the tripartite motif (TRIM) family. The TRIM motif includes three zinc-binding domains, a RING, a B-box type 1 and a B-box type 2, and a coiled-coil region. The protein localizes to cytoplasmic bodies. The protein has also been localized to the nucleus, where it interacts with the activation domain of the HIV-1 Tat protein. The Tat protein activates transcription of HIV-1 genes. [provided by RefSeq, July 2008]. Transcript Variant: This variant (2) uses a different splice site in the 5' UTR, compared to variant 1. Variants 1 and 2 encode the same protein. |
| TRIML1 | 414 | Exonic | 339976 | probable E3 ubiquitin-protein ligase TRIML1 | N/A |
| TRIO | 415 | Exonic | 7204 | triple functional domain protein | N/A |
| TSGA10 | 416 | Exonic | 80705 | testis-specific gene 10 protein | N/A |
| TSPAN10 | 417 | Exonic | 83882 | tetraspanin-10 | N/A |
| TXLNB | 418 | Exonic | 167838 | beta-taxilin | N/A |
| TXNIP | 419 | Exonic | 10628 | thioredoxin-interacting protein | N/A |
| UBA6 | 420 | Exonic | 55236 | ubiquitin-like modifier-activating enzyme 6 | Modification of proteins with ubiquitin (UBB; MIM 191339) or ubiquitin-like proteins controls many signaling networks and requires a ubiquitin-activating enzyme (E1), a ubiquitin conjugating enzyme (E2), and a ubiquitin protein ligase (E3). UBE1L2 is an E1 enzyme that initiates the activation and conjugation of ubiquitin-like proteins (Jin et al., 2007 [PubMed 17597759]). [supplied by OMIM, March 2008]. |
| UBR1 | 421 | Exonic | 197131 | E3 ubiquitin-protein ligase UBR1 | The N-end rule pathway is one proteolytic pathway of the ubiquitin system. The recognition component of this pathway, encoded by this gene, binds to a destabilizing N-terminal residue of a substrate protein and participates in the formation of a substrate-linked multiubiquitin chain. This leads to the eventual degradation of the substrate protein. The protein described in this record has a RING-type zinc finger and a UBR-type zinc finger. Mutations in this gene have been associated with Johanson-Blizzard syndrome. [provided by RefSeq, July 2008]. |
| UGT2A1 | 422 | Exonic | 10941 | UDP-glucuronosyl-transferase | The protein encoded by this gene belongs to the UDP-glycosyltransferase family, members of which catalyze biotransformation reactions in which lipophilic substrates are conjugated with glucuronic acid to increase water |

TABLE 3-continued

| GENE NAME | Gene ID # | CNV Gene Region | NCBI Gene ID | Gene Description | RefSeq Summmary |
|---|---|---|---|---|---|
| UGT2A2 | 423 | Exonic | 574537 | UDP-glucuronosyl-transferase 2A2 2A1 isoform 3 precursor | solubility and enhance excretion. They are of major importance in the conjugation and subsequent elimination of potentially toxic xenobiotics and endogenous compounds. This enzyme is expressed in the olfactory neuroepithelium, which lines the posterior nasal cavity and is exposed to a wide range of odorants and airborne toxic compounds. Hence, this protein has been suggested to be involved in clearing lipophilic odorant molecules from the sensory epithelium. Alternatively spliced transcript variants encoding different isoforms have been found for this gene. [provided by RefSeq, November 2011]. Transcript Variant: This variant (3) contains an additional in-frame coding exon in the 5' region, and lacks an in-frame coding exon in the 3' region compared to variant 1. This results in an isoform (3) of the same length, but differing in two internal protein segments compared to isoform 1. |
| ULK1 | 424 | Exonic | 8408 | serine/threonine-protein kinase ULK1 | N/A |
| UPF0639 | 425 | Exonic | N/A | N/A | N/A |
| UQCRC1 | 426 | Exonic | 7384 | cytochrome b-c1 complex subunit 1, mitochondrial precursor | N/A |
| USP9X | 427 | Exonic | 8239 | probable ubiquitin carboxyl-terminal hydrolase FAF-X isoform 4 | This gene is a member of the peptidase C19 family and encodes a protein that is similar to ubiquitin-specific proteases. Though this gene is located on the X chromosome, it escapes X-inactivation. Mutations in this gene have been associated with Turner syndrome. Alternate transcriptional splice variants, encoding different isoforms, have been characterized. [provided by RefSeq, July 2008]. Transcript Variant: This variant (4) uses an alternate in-frame splice site at the 3' end of an exon compared to variant 3. The resulting isoform (4) has the same N- and C-termini but is shorter compared to isoform 3. |
| UST | 428 | Exonic | 10090 | uronyl 2-sulfotransferase | Uronyl 2-sulfotransferase transfers sulfate to the 2-position of uronyl residues, such as iduronyl residues in dermatan sulfate and glucuronyl residues in chondroitin sulfate (Kobayashi et al., 1999 [PubMed 10187838]). [supplied by OMIM, March 2008]. |
| UXS1 | 429 | Exonic | 80146 | UDP-glucuronic acid decarboxylase 1 | UDP-glucuronate decarboxylase (UGD; EC 4.1.1.35) catalyzes the formation of UDP-xylose from UDP-glucuronate. UDP-xylose is then used to initiate glycosaminoglycan biosynthesis on the core protein of proteoglycans. [supplied by OMIM, January 2006]. |
| VN1R1 | 430 | Exonic | 57191 | vomeronasal type-1 receptor 1 | Pheromones are chemical signals that elicit specific behavioral responses and physiologic alterations in recipients of the same species. The protein encoded by this gene is similar to pheromone receptors and is primarily localized to the olfactory mucosa. An alternate splice variant of this gene is thought to exist, but its full length nature has not been determined. [provided by RefSeq, July 2008]. Sequence Note: This RefSeq record was created from transcript and genomic sequence data to make the sequence consistent with the reference genome assembly. The genomic coordinates used for the transcript record were based on transcript alignments. |

TABLE 3-continued

| GENE NAME | CNV Gene Region | Gene ID # | NCBI Gene ID | Gene Description | RefSeq Summary |
|---|---|---|---|---|---|
| VPS13A | Exonic | 431 | 23230 | vacuolar protein sorting-associated protein 13A isoform B | The protein encoded by this gene may control steps in the cycling of proteins through the trans-Golgi network to endosomes, lysosomes and the plasma membrane. Mutations in this gene cause the autosomal recessive disorder, chorea-acanthocytosis. Alternative splicing of this gene results in multiple transcript variants. [provided by RefSeq, July 2008]. Transcript Variant: This variant (B) contains a distinct 3' coding region and 3' UTR, compared to variant A. The resulting isoform (B) has a shorter C-terminus compared to isoform A. |
| VPS53 | Exonic | 432 | 55275 | vacuolar protein sorting-associated protein 53 homolog isoform 1 | This gene encodes a protein with sequence similarity to the yeast Vps53p protein. Vps53p is involved in retrograde vesicle trafficking in late Golgi. [provided by RefSeq, July 2008]. Transcript Variant: This variant (1) represents the longer transcript and it encodes the longer protein (isoform 1). Sequence Note: This RefSeq record was created from transcript and genomic sequence data to make the sequence consistent with the reference genome assembly. The genomic coordinates used for the transcript record were based on transcript alignments. |
| VWA3A | Exonic | 433 | 146177 | von Willebrand factor A domain-containing protein 3A precursor | N/A |
| WIZ | Exonic | 434 | 58525 | protein Wiz | N/A |
| XG | Exonic | 435 | 7499 | glycoprotein Xg isoform 3 precursor | This gene encodes the XG blood group antigen, and is located at the pseudoautosomal boundary on the short (p) arm of chromosome X. The three 5' exons reside in the pseudoautosomal region and the remaining exons within the X-specific end. A truncated copy of this gene is found on the Y chromosome at the pseudoautosomal boundary. It is transcribed, but not expected to make a Y-chromosome specific gene product. Alternatively spliced transcript variants encoding different isoforms have been found for this gene. [provided by RefSeq, November 2008]. Transcript Variant: This variant (3) uses an alternate donor splice site at one of the coding exons compared to transcript variant 1, resulting in an isoform (3) containing one additional aa compared to isoform 1. Sequence Note: This RefSeq record was created from transcript and genomic sequence data because no quality transcript was available for the full length of the gene. The extent of this transcript is supported by transcript alignments. Sequence Note: This RefSeq record represents the XG*001.1.1 allele. |
| XPO6 | Exonic | 436 | 23214 | exportin-6 | Exportins, such as XPO6, recruit cargo in the nucleoplasm in the presence of RAN (MIM 601179)-GTP and form ternary export complexes. These complexes are transported through nuclear pore complexes to the cytoplasm, where GTP is hydrolyzed and the export complex is disassembled. [supplied by OMIM, April 2004]. |
| XYLB | Exonic | 437 | 9942 | xylulose kinase | The protein encoded by this gene shares 22% sequence identity with Hemophilus influenzae xylulokinase, and even higher identity to other gene products in C. elegans (45%) and yeast (31-35%), which are thought to belong to a family of enzymes that include fucokinase, gluconokinase, glycerokinase and xylulokinase. These proteins play important roles in energy metabolism. [provided by RefSeq, August 2009]. |
| YIPF7 | Exonic | 438 | 285525 | protein YIPF7 | N/A |
| ZAN | Exonic | 439 | 7455 | zonadhesin isoform 6 precursor | This gene encodes a sperm membrane protein that binds the zona pellucida of the egg in a species-specific manner. The encoded protein may be involved in signaling or gamete recognition. Alternate transcriptional splice variants, |

TABLE 3-continued

| GENE NAME | Gene ID # | CNV Gene Region | NCBI Gene ID | Gene Description | RefSeq Summmary |
|---|---|---|---|---|---|
| ZDHHC19 | 440 | Exonic | 131540 | probable palmitoyltransferase ZDHHC19 | encoding different isoforms, have been characterized. [provided by RefSeq, July 2008]. Transcript Variant: This variant (6) has multiple differences in the coding region but maintains the reading frame, compared to variant 3. This variant encodes isoform 6 which is 91 aa shorter than isoform 3. |
| | 441 | Exonic | 51114 | palmitoyltransferase ZDHHC9 | N/A |
| ZDHHC9 | | | | | This gene encodes an integral membrane protein that is a member of the zinc finger DHHC domain-containing protein family. The encoded protein forms a complex with golgin subfamily A member 7 and functions as a palmitoyltransferase. This protein specifically palmitoylates HRAS and NRAS. Mutations in this gene are associated with X-linked mental retardation. Alternate splicing results in multiple transcript variants that encode the same protein. [provided by RefSeq, May 2010]. Transcript Variant: This variant (1) is the longer transcript and both variants 1 and 2 encode the same protein. Sequence Note: This RefSeq record was created from transcript and genomic sequence data to make the sequence consistent with the reference genome assembly. The genomic coordinates used for the transcript record were based on transcript alignments. |
| ZIM3 | 442 | Exonic | 114026 | zinc finger imprinted 3 | N/A |
| ZNF185 | 443 | Exonic | 7739 | zinc finger protein 185 isoform 9 | Zinc-finger proteins bind nucleic acids and play important roles in various cellular functions, including cell proliferation, differentiation, and apoptosis. This gene encodes a LIM-domain zinc finger protein. The LIM domain is composed of two contiguous zinc finger domains, separated by a two-amino acid residue hydrophobic linker. The LIM domain mediates protein:protein interactions. Multiple alternatively spliced transcript variants encoding different isoforms have been identified. [provided by RefSeq, May 2010]. Transcript Variant: This variant (9) lacks multiple 5' eons, but has an alternate 5' exon, as compared to variant 1. The resulting isoform (9) is much shorter and has a different N-terminus, as compared to isoform 1. |
| ZNF324B | 444 | Exonic | 388569 | zinc finger protein 324B | N/A |
| ZNF333 | 445 | Exonic | 84449 | zinc finger protein 333 | N/A |
| ZNF37BP | 446 | Exonic | 100129482 | N/A | N/A |
| ZNF618 | 447 | Exonic | 114991 | zinc finger protein 618 | N/A |
| ZNF626 | 448 | Exonic | 199777 | zinc finger protein 626 isoform 2 | N/A |
| ZNF808 | 449 | Exonic | 388558 | zinc finger protein 808 | N/A |
| ZNF878 | 450 | Exonic | 729747 | zinc finger protein 878 | N/A |
| ZRANB3 | 451 | Exonic | 84083 | zinc finger Ran-binding domain-containing protein 3 | N/A |

Table 3 represents a non-redundant list for all genes listed in Table 2 (namely, those relevant to the CNV subregion). Column 1 refers to the genes name. Column 2 refers to whether the CNV Gene Region is intronic, exonic or both. "Intronic" refers to CNV subregions affecting introns only; "Exonic" refers to CNV subregions affecting part or all of one or more exons, which may include adjacent intronic regions if the CNV subregion extends beyond the exonic region. Column 3 refers to the DNA Accession number. Column 4 refers to a brief description for each respective gene. Column 5 refers to a summary of each respective gene's function

TABLE 4

| RefSeq Gene Symbol | CNV Gene Region | SEQ_ID | RefSeq Accession Number | RefSeq Gene Description/Definition (transcript variant = tv; HS = HS) |
|---|---|---|---|---|
| CSNK1D | exonic | SEQ ID 644 | NM_001893 | HS casein kinase 1, delta (CSNK1D), tv1, mRNA. |
| SLC16A3 | exonic | SEQ ID 645 | NM_001042423 | HS solute carrier family 16, member 3 (monocarboxylic acid transporter 4) (SLC16A3), tv4, mRNA. |
| CSNK1D | exonic | SEQ ID 646 | NM_139062 | HS casein kinase 1, delta (CSNK1D), tv2, mRNA. |
| SLC16A3 | exonic | SEQ ID 647 | NM_004207 | HS solute carrier family 16, member 3 (monocarboxylic acid transporter 4) (SLC16A3), tv3, mRNA. |
| SLC16A3 | exonic | SEQ ID 648 | NM_001206952 | HS solute carrier family 16, member 3 (monocarboxylic acid transporter 4) (SLC16A3), tv6, mRNA. |
| SLC16A3 | exonic | SEQ ID 649 | NM_001206951 | HS solute carrier family 16, member 3 (monocarboxylic acid transporter 4) (SLC16A3), tv5, mRNA. |
| SLC16A3 | exonic | SEQ ID 650 | NM_001042422 | HS solute carrier family 16, member 3 (monocarboxylic acid transporter 4) (SLC16A3), tv2, mRNA. |
| SLC16A3 | exonic | SEQ ID 651 | NM_001206950 | HS solute carrier family 16, member 3 (monocarboxylic acid transporter 4) (SLC16A3), tv1, mRNA. |
| SIRT7 | exonic | SEQ ID 652 | NM_016538 | HS sirtuin 7 (SIRT7), mRNA. |
| NPLOC4 | exonic | SEQ ID 653 | NM_017921 | HS nuclear protein localization 4 homolog (*S. cerevisiae*) (NPLOC4), mRNA. |
| CCDC57 | exonic | SEQ ID 654 | NM_198082 | HS coiled-coil domain containing 57 (CCDC57), mRNA. |
| MIR3186 | exonic | SEQ ID 655 | NR_036152 | HS microRNA 3186 (MIR3186), microRNA. |
| BAHCC1 | exonic | SEQ ID 656 | NM_001080519 | HS BAH domain and coiled-coil containing 1 (BAHCC1), mRNA. |
| MIR4740 | exonic | SEQ ID 657 | NR_039894 | HS microRNA 4740 (MIR4740), microRNA. |
| ACTG1 | exonic | SEQ ID 658 | NM_001199954 | HS actin, gamma 1 (ACTG1), tv1, mRNA. |
| C17orf70 | exonic | SEQ ID 659 | NR_033338 | HS chromosome 17 open reading frame 70 (C17orf70), tv1, non-coding RNA. |
| ACTG1 | exonic | SEQ ID 660 | NM_001614 | HS actin, gamma 1 (ACTG1), tv2, mRNA. |
| FSCN2 | exonic | SEQ ID 661 | NM_012418 | HS fascin homolog 2, actin-bundling protein, retinal (*Strongylocentrotus purpuratus*) (FSCN2), tv1, mRNA. |
| FSCN2 | exonic | SEQ ID 662 | NM_001077182 | HS fascin homolog 2, actin-bundling protein, retinal (*Strongylocentrotus purpuratus*) (FSCN2), tv2, mRNA. |
| C17orf70 | exonic | SEQ ID 663 | NM_025161 | HS chromosome 17 open reading frame 70 (C17orf70), tv2, mRNA. |
| ACTG1 | exonic | SEQ ID 664 | NR_037688 | HS actin, gamma 1 (ACTG1), tv3, non-coding RNA. |
| HGS | exonic | SEQ ID 665 | NM_004712 | HS hepatocyte growth factor-regulated tyrosine kinase substrate (HGS), mRNA. |
| SLC25A10 | exonic | SEQ ID 666 | NM_001270888 | HS solute carrier family 25 (mitochondrial carrier; dicarboxylate transporter), member 10 (SLC25A10), nuclear gene encoding mitochondrial protein, tv1, mRNA. |
| OXLD1 | exonic | SEQ ID 667 | NM_001039842 | HS oxidoreductase-like domain containing 1 (OXLD1), mRNA. |
| CCDC137 | exonic | SEQ ID 668 | NM_199287 | HS coiled-coil domain containing 137 (CCDC137), mRNA. |
| PDE6G | exonic | SEQ ID 669 | NR_026872 | HS phosphodiesterase 6G, cGMP-specific, rod, gamma (PDE6G), tv2, non-coding RNA. |
| PDE6G | exonic | SEQ ID 670 | NM_002602 | HS phosphodiesterase 6G, cGMP-specific, rod, gamma (PDE6G), tv1, mRNA. |
| SLC25A10 | exonic | SEQ ID 671 | NM_001270953 | HS solute carrier family 25 (mitochondrial carrier; dicarboxylate transporter), member 10 (SLC25A10), nuclear gene encoding mitochondrial protein, tv3, mRNA. |
| SLC25A10 | exonic | SEQ ID 672 | NM_012140 | HS solute carrier family 25 (mitochondrial carrier; dicarboxylate transporter), member 10 (SLC25A10), nuclear gene encoding mitochondrial protein, tv2, mRNA. |
| TSPAN10 | exonic | SEQ ID 673 | NM_031945 | HS tetraspanin 10 (TSPAN10), mRNA. |
| ARL16 | exonic | SEQ ID 674 | NM_001040025 | HS ADP-ribosylation factor-like 16 (ARL16), mRNA. |
| MRPL12 | exonic | SEQ ID 675 | NM_002949 | HS mitochondrial ribosomal protein L12 (MRPL12), nuclear gene encoding mitochondrial protein, mRNA. |
| PCYT2 | exonic | SEQ ID 676 | NM_001256435 | HS phosphate cytidylyltransferase 2, ethanolamine (PCYT2), tv4, mRNA. |
| P4HB | exonic | SEQ ID 677 | NM_000918 | HS prolyl 4-hydroxylase, beta polypeptide (P4HB), mRNA. |
| PCYT2 | exonic | SEQ ID 678 | NM_002861 | HS phosphate cytidylyltransferase 2, ethanolamine (PCYT2), tv2, mRNA. |
| PCYT2 | exonic | SEQ ID 679 | NM_001256434 | HS phosphate cytidylyltransferase 2, ethanolamine (PCYT2), tv3, mRNA. |
| ARHGDIA | exonic | SEQ ID 680 | NM_004309 | HS Rho GDP dissociation inhibitor (GDI) alpha (ARHGDIA), tv2, mRNA. |
| ARHGDIA | exonic | SEQ ID 681 | NM_001185078 | HS Rho GDP dissociation inhibitor (GDI) alpha (ARHGDIA), tv3, mRNA. |
| ARHGDIA | exonic | SEQ ID 682 | NM_001185077 | HS Rho GDP dissociation inhibitor (GDI) alpha (ARHGDIA), tv1, mRNA. |
| PPP1R27 | exonic | SEQ ID 683 | NM_001007533 | HS protein phosphatase 1, regulatory subunit 27 (PPP1R27), mRNA. |
| NPB | exonic | SEQ ID 684 | NM_148896 | HS neuropeptide B (NPB), mRNA. |
| ALYREF | exonic | SEQ ID 685 | NM_005782 | HS Aly/REF export factor (ALYREF), mRNA. |
| PCYT2 | exonic | SEQ ID 686 | NM_001184917 | HS phosphate cytidylyltransferase 2, ethanolamine (PCYT2), tv1, mRNA. |
| ANAPC11 | exonic | SEQ ID 687 | NM_016476 | HS anaphase promoting complex subunit 11 (ANAPC11), tv2, mRNA. |
| PCYT2 | exonic | SEQ ID 688 | NM_001256433 | HS phosphate cytidylyltransferase 2, ethanolamine (PCYT2), tv7, mRNA. |
| PCYT2 | exonic | SEQ ID 689 | NR_033683 | HS phosphate cytidylyltransferase 2, ethanolamine (PCYT2), tv5, non-coding RNA. |
| PCYT2 | exonic | SEQ ID 690 | NR_033685 | HS phosphate cytidylyltransferase 2, ethanolamine (PCYT2), tv6, non-coding RNA. |
| ANAPC11 | exonic | SEQ ID 691 | NM_001002249 | HS anaphase promoting complex subunit 11 (ANAPC11), tv7, mRNA. |
| ANAPC11 | exonic | SEQ ID 692 | NM_001002248 | HS anaphase promoting complex subunit 11 (ANAPC11), tv6, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| ANAPC11 | exonic | SEQ ID 693 | NM_001002247 | HS anaphase promoting complex subunit 11 (ANAPC11), tv5, mRNA. |
| ANAPC11 | exonic | SEQ ID 694 | NM_001002246 | HS anaphase promoting complex subunit 11 (ANAPC11), tv4, mRNA. |
| ANAPC11 | exonic | SEQ ID 695 | NM_001002245 | HS anaphase promoting complex subunit 11 (ANAPC11), tv3, mRNA. |
| ANAPC11 | exonic | SEQ ID 696 | NM_001002244 | HS anaphase promoting complex subunit 11 (ANAPC11), tv1, mRNA. |
| LRRC45 | exonic | SEQ ID 697 | NM_144999 | HS leucine rich repeat containing 45 (LRRC45), mRNA. |
| MAFG-AS1 | exonic | SEQ ID 698 | NR_015454 | HS MAFG antisense RNA 1 (head to head) (MAFG-AS1), non-coding RNA. |
| STRA13 | exonic | SEQ ID 699 | NM_001271006 | HS stimulated by retinoic acid 13 (STRA13), tv1, mRNA. |
| PYCR1 | exonic | SEQ ID 700 | NM_006907 | HS pyrroline-5-carboxylate reductase 1 (PYCR1), tv1, mRNA. |
| MAFG | exonic | SEQ ID 701 | NM_002359 | HS v-maf musculoaponeurotic fibrosarcoma oncogene homolog G (avian) (MAFG), tv1, mRNA. |
| DCXR | exonic | SEQ ID 702 | NM_001195218 | HS dicarbonyl/L-xylulose reductase (DCXR), tv2, mRNA. |
| PYCR1 | exonic | SEQ ID 703 | NM_153824 | HS pyrroline-5-carboxylate reductase 1 (PYCR1), tv2, mRNA. |
| STRA13 | exonic | SEQ ID 704 | NM_001271007 | HS stimulated by retinoic acid 13 (STRA13), tv3, mRNA. |
| NOTUM | exonic | SEQ ID 705 | NM_178493 | HS notum pectinacetylesterase homolog (Drosophila) (NOTUM), mRNA. |
| ASPSCR1 | exonic | SEQ ID 706 | NR_045351 | HS alveolar soft part sarcoma chromosome region, candidate 1 (ASPSCR1), tv3, non-coding RNA. |
| ASPSCR1 | exonic | SEQ ID 707 | NM_024083 | HS alveolar soft part sarcoma chromosome region, candidate 1 (ASPSCR1), tv1, mRNA. |
| MYADML2 | exonic | SEQ ID 708 | NM_001145113 | HS myeloid-associated differentiation marker-like 2 (MYADML2), mRNA. |
| DCXR | exonic | SEQ ID 709 | NM_016286 | HS dicarbonyl/L-xylulose reductase (DCXR), tv1, mRNA. |
| ASPSCR1 | exonic | SEQ ID 710 | NM_001251888 | HS alveolar soft part sarcoma chromosome region, candidate 1 (ASPSCR1), tv2, mRNA. |
| RAC3 | exonic | SEQ ID 711 | NM_005052 | HS ras-related C3 botulinum toxin substrate 3 (rho family, small GTP binding protein Rac3) (RAC3), mRNA. |
| MAFG | exonic | SEQ ID 712 | NM_032711 | HS v-maf musculoaponeurotic fibrosarcoma oncogene homolog G (avian) (MAFG), tv2, mRNA. |
| STRA13 | exonic | SEQ ID 713 | NM_144998 | HS stimulated by retinoic acid 13 (STRA13), tv2, mRNA. |
| RFNG | exonic | SEQ ID 714 | NM_002917 | HS RFNG O-fucosylpeptide 3-beta-N-acetylglucosaminyltransferase (RFNG), mRNA. |
| FASN | exonic | SEQ ID 715 | NM_004104 | HS fatty acid synthase (FASN), mRNA. |
| GPS1 | exonic | SEQ ID 716 | NM_004127 | HS G protein pathway suppressor 1 (GPS1), tv2, mRNA. |
| DUS1L | exonic | SEQ ID 717 | NM_022156 | HS dihydrouridine synthase 1-like (S. cerevisiae) (DUS1L), mRNA. |
| GPS1 | exonic | SEQ ID 718 | NM_212492 | HS G protein pathway suppressor 1 (GPS1), tv1, mRNA. |
| BTNL3 | exonic | SEQ ID 719 | NM_197975 | HS butyrophilin-like 3 (BTNL3), mRNA. |
| ZFP62 | exonic | SEQ ID 720 | NM_152283 | HS ZFP62 zinc finger protein (ZFP62), tv1, mRNA. |
| LINC00847 | ncRNA | SEQ ID 721 | NR_027183 | HS long intergenic non-protein coding RNA 847 (LINC00847), tv1, non-coding RNA. |
| ZFP62 | exonic | SEQ ID 722 | NM_001172638 | HS ZFP62 zinc finger protein (ZFP62), tv2, mRNA. |
| LINC00847 | ncRNA | SEQ ID 723 | NR_045679 | HS long intergenic non-protein coding RNA 847 (LINC00847), tv3, non-coding RNA. |
| LINC00847 | ncRNA | SEQ ID 724 | NR_045678 | HS long intergenic non-protein coding RNA 847 (LINC00847), tv2, non-coding RNA. |
| LINC-HEIH | ncRNA | SEQ ID 725 | NR_045680 | HS long intergenic non-protein coding RNA, highly expressed in hepatocellular carcinoma (LINC-HEIH), non-coding RNA. |
| BTNL8 | exonic | SEQ ID 726 | NM_024850 | HS butyrophilin-like 8 (BTNL8), tv1, mRNA. |
| BTNL8 | exonic | SEQ ID 727 | NM_001159710 | HS butyrophilin-like 8 (BTNL8), tv6, mRNA. |
| BTNL8 | exonic | SEQ ID 728 | NM_001159708 | HS butyrophilin-like 8 (BTNL8), tv4, mRNA. |
| BTNL8 | exonic | SEQ ID 729 | NM_001159707 | HS butyrophilin-like 8 (BTNL8), tv3, mRNA. |
| BTNL8 | exonic | SEQ ID 730 | NM_001159709 | HS butyrophilin-like 8 (BTNL8), tv5, mRNA. |
| BTNL8 | exonic | SEQ ID 731 | NM_001040462 | HS butyrophilin-like 8 (BTNL8), tv2, mRNA. |
| CNTNAP2 | both | SEQ ID 732 | NM_014141 | HS contactin associated protein-like 2 (CNTNAP2), mRNA. |
| VIMP | exonic | SEQ ID 733 | NM_203472 | HS VCP-interacting membrane protein (VIMP), tv1, mRNA. |
| VIMP | exonic | SEQ ID 734 | NM_018445 | HS VCP-interacting membrane protein (VIMP), tv2, mRNA. |
| MAOA | intronic | SEQ ID 735 | NM_001270458 | HS monoamine oxidase A (MAOA), tv2, mRNA. |
| MAOA | intronic | SEQ ID 736 | NM_000240 | HS monoamine oxidase A (MAOA), nuclear gene encoding mitochondrial protein, tv1, mRNA. |
| KANSL1 | exonic | SEQ ID 737 | NM_015443 | HS KAT8 regulatory NSL complex subunit 1 (KANSL1), tv2, mRNA. |
| KANSL1 | exonic | SEQ ID 738 | NM_001193466 | HS KAT8 regulatory NSL complex subunit 1 (KANSL1), tv1, mRNA. |
| KANSL1 | exonic | SEQ ID 739 | NM_001193465 | HS KAT8 regulatory NSL complex subunit 1 (KANSL1), tv3, mRNA. |
| KANSL1-AS1 | exonic | SEQ ID 740 | NR_034172 | HS KANSL1 antisense RNA 1 (KANSL1-AS1), non-coding RNA. |
| NSFP1 | exonic | SEQ ID 741 | NR_033799 | HS N-ethylmaleimide-sensitive factor pseudogene 1 (NSFP1), non-coding RNA. |
| NSF | exonic | SEQ ID 742 | NM_006178 | HS N-ethylmaleimide-sensitive factor (NSF), tv1, mRNA. |
| NSF | exonic | SEQ ID 743 | NR_040116 | HS N-ethylmaleimide-sensitive factor (NSF), tv2, non-coding RNA. |
| ARL17B | exonic | SEQ ID 744 | NM_001103154 | HS ADP-ribosylation factor-like 17B (ARL17B), tv2, mRNA. |
| LRRC37A | exonic | SEQ ID 745 | NM_014834 | HS leucine rich repeat containing 37A (LRRC37A), mRNA. |
| ARL17B | exonic | SEQ ID 746 | NM_001039083 | HS ADP-ribosylation factor-like 17B (ARL17B), tv1, mRNA. |
| ARL17A | exonic | SEQ ID 747 | NM_001113738 | HS ADP-ribosylation factor-like 17A (ARL17A), tv1, mRNA. |
| ARL17A | exonic | SEQ ID 748 | NM_016632 | HS ADP-ribosylation factor-like 17A (ARL17A), tv2, mRNA. |
| LRRC37A2 | exonic | SEQ ID 749 | NM_001006607 | HS leucine rich repeat containing 37, member A2 (LRRC37A2), mRNA. |
| COL24A1 | exonic | SEQ ID 750 | NM_152890 | HS collagen, type XXIV, alpha 1 (COL24A1), mRNA. |
| CLPSL2 | exonic | SEQ ID 751 | NM_207409 | HS colipase-like 2 (CLPSL2), mRNA. |
| CLPSL1 | exonic | SEQ ID 752 | NM_001010886 | HS colipase-like 1 (CLPSL1), mRNA. |
| CLPS | exonic | SEQ ID 753 | NM_001252598 | HS colipase, pancreatic (CLPS), tv3, mRNA. |
| CLPS | exonic | SEQ ID 754 | NM_001832 | HS colipase, pancreatic (CLPS), tv1, mRNA. |
| CLPS | exonic | SEQ ID 755 | NM_001252597 | HS colipase, pancreatic (CLPS), tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| ULK1 | exonic | SEQ ID 756 | NM_003565 | HS unc-51-like kinase 1 (*C. elegans*) (ULK1), mRNA. |
| MYH6 | exonic | SEQ ID 757 | NM_002471 | HS myosin, heavy chain 6, cardiac muscle, alpha (MYH6), mRNA. |
| MYH7 | exonic | SEQ ID 758 | NM_000257 | HS myosin, heavy chain 7, cardiac muscle, beta (MYH7), mRNA. |
| MIR208B | exonic | SEQ ID 759 | NR_030624 | HS microRNA 208b (MIR208B), microRNA. |
| MTRNR2L6 | exonic | SEQ ID 760 | NM_001190487 | HS MT-RNR2-like 6 (MTRNR2L6), mRNA. |
| PRSS1 | exonic | SEQ ID 761 | NM_002769 | HS protease, serine, 1 (trypsin 1) (PRSS1), mRNA. |
| PRSS3P2 | exonic | SEQ ID 762 | NR_001296 | HS protease, serine, 3 pseudogene 2 (PRSS3P2), non-coding RNA. |
| PRSS2 | exonic | SEQ ID 763 | NM_002770 | HS protease, serine, 2 (trypsin 2) (PRSS2), mRNA. |
| ZNF333 | exonic | SEQ ID 764 | NM_032433 | HS zinc finger protein 333 (ZNF333), mRNA. |
| PRDM6 | exonic | SEQ ID 765 | NM_001136239 | HS PR domain containing 6 (PRDM6), mRNA. |
| C2orf48 | exonic | SEQ ID 766 | NM_182626 | HS chromosome 2 open reading frame 48 (C2orf48), mRNA. |
| SYNGAP1 | exonic | SEQ ID 767 | NM_006772 | HS synaptic Ras GTPase activating protein 1 (SYNGAP1), mRNA. |
| CUTA | exonic | SEQ ID 768 | NM_001014433 | HS cutA divalent cation tolerance homolog (*E. coli*) (CUTA), tv1, mRNA. |
| PHF1 | exonic | SEQ ID 769 | NR_027692 | HS PHD finger protein 1 (PHF1), tv3, non-coding RNA. |
| PHF1 | exonic | SEQ ID 770 | NM_024165 | HS PHD finger protein 1 (PHF1), tv2, mRNA. |
| PHF1 | exonic | SEQ ID 771 | NM_002636 | HS PHD finger protein 1 (PHF1), tv1, mRNA. |
| CUTA | exonic | SEQ ID 772 | NM_001014840 | HS cutA divalent cation tolerance homolog (*E. coli*) (CUTA), tv5, mRNA. |
| CUTA | exonic | SEQ ID 773 | NM_001014838 | HS cutA divalent cation tolerance homolog (*E. coli*) (CUTA), tv4, mRNA. |
| CUTA | exonic | SEQ ID 774 | NM_001014837 | HS cutA divalent cation tolerance homolog (*E. coli*) (CUTA), tv3, mRNA. |
| CUTA | exonic | SEQ ID 775 | NM_015921 | HS cutA divalent cation tolerance homolog (*E. coli*) (CUTA), tv2, mRNA. |
| OR52N1 | exonic | SEQ ID 776 | NM_001001913 | HS olfactory receptor, family 52, subfamily N, member 1 (OR52N1), mRNA. |
| OR52N5 | exonic | SEQ ID 777 | NM_001001922 | HS olfactory receptor, family 52, subfamily N, member 5 (OR52N5), mRNA. |
| KIFC1 | exonic | SEQ ID 778 | NM_002263 | HS kinesin family member C1 (KIFC1), mRNA. |
| MIR935 | exonic | SEQ ID 779 | NR_030632 | HS microRNA 935 (MIR935), microRNA. |
| CACNG8 | exonic | SEQ ID 780 | NM_031895 | HS calcium channel, voltage-dependent, gamma subunit 8 (CACNG8), mRNA. |
| EBF3 | exonic | SEQ ID 781 | NM_001005463 | HS early B-cell factor 3 (EBF3), mRNA. |
| MNS1 | exonic | SEQ ID 782 | NM_018365 | HS meiosis-specific nuclear structural 1 (MNS1), mRNA. |
| TEX9 | exonic | SEQ ID 783 | NM_198524 | HS testis expressed 9 (TEX9), mRNA. |
| ANKRD33B | exonic | SEQ ID 784 | NM_001164440 | HS ankyrin repeat domain 33B (ANKRD33B), mRNA. |
| AIG1 | exonic | SEQ ID 785 | NM_016108 | HS androgen-induced 1 (AIG1), mRNA. |
| MARCH6 | exonic | SEQ ID 786 | NM_005885 | HS membrane-associated ring finger (C3HC4) 6, E3 ubiquitin protein ligase (MARCH6), tv1, mRNA. |
| MARCH6 | exonic | SEQ ID 787 | NM_001270661 | HS membrane-associated ring finger (C3HC4) 6, E3 ubiquitin protein ligase (MARCH6), tv3, mRNA. |
| CTNND2 | exonic | SEQ ID 788 | NM_001332 | HS catenin (cadherin-associated protein), delta 2 (CTNND2), mRNA. |
| SEMA5A | exonic | SEQ ID 789 | NM_003966 | HS sema domain, seven thrombospondin repeats (type 1 and type 1-like), transmembrane domain (TM) and short cytoplasmic domain, (semaphorin) 5A (SEMA5A), mRNA. |
| MARCH6 | exonic | SEQ ID 790 | NM_001270660 | HS membrane-associated ring finger (C3HC4) 6, E3 ubiquitin protein ligase (MARCH6), tv2, mRNA. |
| CMBL | exonic | SEQ ID 791 | NM_138809 | HS carboxymethylenebutenolidase homolog (*Pseudomonas*) (CMBL), mRNA. |
| LOC285692 | exonic | SEQ ID 792 | NR_027112 | HS uncharacterized LOC285692 (LOC285692), non-coding RNA. |
| DAP | exonic | SEQ ID 793 | NM_004394 | HS death-associated protein (DAP), mRNA. |
| CT49 | ncRNA | SEQ ID 794 | NR_033383 | HS cancer/testis antigen 49 (non-protein coding) (CT49), non-coding RNA. |
| TAS2R1 | exonic | SEQ ID 795 | NM_019599 | HS taste receptor, type 2, member 1 (TAS2R1), mRNA. |
| LOC100505806 | exonic | SEQ ID 796 | NR_045196 | HS uncharacterized LOC100505806 (LOC100505806), non-coding RNA. |
| SNORD123 | exonic | SEQ ID 797 | NR_003689 | HS small nucleolar RNA, C/D box 123 (SNORD123), small nucleolar RNA. |
| FAM173B | exonic | SEQ ID 798 | NM_199133 | HS family with sequence similarity 173, member B (FAM173B), tv1, mRNA. |
| CCT5 | exonic | SEQ ID 799 | NM_012073 | HS chaperonin containing TCP1, subunit 5 (epsilon) (CCT5), mRNA. |
| FAM173B | exonic | SEQ ID 800 | NM_001258388 | HS family with sequence similarity 173, member B (FAM173B), tv2, mRNA. |
| FAM173B | exonic | SEQ ID 801 | NM_001258389 | HS family with sequence similarity 173, member B (FAM173B), tv3, mRNA. |
| FAM173B | exonic | SEQ ID 802 | NR_047670 | HS family with sequence similarity 173, member B (FAM173B), tv6, non-coding RNA. |
| FAM173B | exonic | SEQ ID 803 | NR_047669 | HS family with sequence similarity 173, member B (FAM173B), tv5, non-coding RNA. |
| FAM173B | exonic | SEQ ID 804 | NR_047668 | HS family with sequence similarity 173, member B (FAM173B), tv4, non-coding RNA. |
| ROPN1L | exonic | SEQ ID 805 | NM_001201466 | HS rhophilin associated tail protein 1-like (ROPN1L), tv2, mRNA. |
| ROPN1L | exonic | SEQ ID 806 | NM_031916 | HS rhophilin associated tail protein 1-like (ROPN1L), tv1, mRNA. |
| C16orf89 | exonic | SEQ ID 807 | NM_001098514 | HS chromosome 16 open reading frame 89 (C16orf89), tv2, mRNA. |
| C16orf89 | exonic | SEQ ID 808 | NM_152459 | HS chromosome 16 open reading frame 89 (C16orf89), tv1, mRNA. |
| ELK3 | exonic | SEQ ID 809 | NM_005230 | HS ELK3, ETS-domain protein (SRF accessory protein 2) (ELK3), mRNA. |
| C11orf96 | exonic | SEQ ID 810 | NM_001145033 | HS chromosome 11 open reading frame 96 (C11orf96), mRNA. |
| CREBBP | exonic | SEQ ID 811 | NM_001079846 | HS CREB binding protein (CREBBP), tv2, mRNA. |
| CREBBP | exonic | SEQ ID 812 | NM_004380 | HS CREB binding protein (CREBBP), tv1, mRNA. |
| HEATR4 | exonic | SEQ ID 813 | NM_203309 | HS HEAT repeat containing 4 (HEATR4), tv2, mRNA. |
| HEATR4 | exonic | SEQ ID 814 | NM_001220484 | HS HEAT repeat containing 4 (HEATR4), tv1, mRNA. |
| SRL | exonic | SEQ ID 815 | NM_001098814 | HS sarcalumenin (SRL), mRNA. |
| PKD1L2 | exonic | SEQ ID 816 | NM_052892 | HS polycystic kidney disease 1-like 2 (PKD1L2), tv1, mRNA. |
| C11orf49 | exonic | SEQ ID 817 | NM_001003678 | HS chromosome 11 open reading frame 49 (C11orf49), tv4, mRNA. |
| ARFGAP2 | exonic | SEQ ID 818 | NM_001242832 | HS ADP-ribosylation factor GTPase activating protein 2 (ARFGAP2), tv2, mRNA. |
| ARFGAP2 | exonic | SEQ ID 819 | NM_032389 | HS ADP-ribosylation factor GTPase activating protein 2 (ARFGAP2), tv1, mRNA. |
| PACSIN3 | exonic | SEQ ID 820 | NM_016223 | HS protein kinase C and casein kinase substrate in neurons 3 (PACSIN3), tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| PACSIN3 | exonic | SEQ ID 821 | NM_001184975 | HS protein kinase C and casein kinase substrate in neurons 3 (PACSIN3), tv1, mRNA. |
| PACSIN3 | exonic | SEQ ID 822 | NM_001184974 | HS protein kinase C and casein kinase substrate in neurons 3 (PACSIN3), tv3, mRNA. |
| PKD1L2 | exonic | SEQ ID 823 | NM_001076780 | HS polycystic kidney disease 1-like 2 (PKD1L2), tv3, mRNA. |
| GYG2 | exonic | SEQ ID 824 | NM_001184703 | HS glycogenin 2 (GYG2), tv4, mRNA. |
| GYG2 | exonic | SEQ ID 825 | NM_003918 | HS glycogenin 2 (GYG2), tv2, mRNA. |
| GYG2 | exonic | SEQ ID 826 | NM_001079855 | HS glycogenin 2 (GYG2), tv1, mRNA. |
| GYG2 | exonic | SEQ ID 827 | NM_001184704 | HS glycogenin 2 (GYG2), tv5, mRNA. |
| GYG2 | exonic | SEQ ID 828 | NM_001184702 | HS glycogenin 2 (GYG2), tv3, mRNA. |
| GCSH | exonic | SEQ ID 829 | NM_004483 | HS glycine cleavage system protein H (aminomethyl carrier) (GCSH), nuclear gene encoding mitochondrial protein, tv1, mRNA. |
| GCSH | exonic | SEQ ID 830 | NR_033249 | HS glycine cleavage system protein H (aminomethyl carrier) (GCSH), tv2, non-coding RNA. |
| C16orf96 | exonic | SEQ ID 831 | NM_001145011 | HS chromosome 16 open reading frame 96 (C16orf96), mRNA. |
| ACOT1 | exonic | SEQ ID 832 | NM_001037161 | HS acyl-CoA thioesterase 1 (ACOT1), mRNA. |
| ALMS1P | exonic | SEQ ID 833 | NR_003683 | HS Alstrom syndrome 1 pseudogene (ALMS1P), non-coding RNA. |
| NAT8B | exonic | SEQ ID 834 | NM_016347 | HS N-acetyltransferase 8B (GCN5-related, putative, gene/pseudogene) (NAT8B), mRNA. |
| ACOT2 | exonic | SEQ ID 835 | NM_006821 | HS acyl-CoA thioesterase 2 (ACOT2), nuclear gene encoding mitochondrial protein, tv1, mRNA. |
| ACOT2 | exonic | SEQ ID 836 | NR_046028 | HS acyl-CoA thioesterase 2 (ACOT2), tv2, non-coding RNA. |
| NAT8 | exonic | SEQ ID 837 | NM_003960 | HS N-acetyltransferase 8 (GCN5-related, putative) (NAT8), mRNA. |
| C14orf169 | exonic | SEQ ID 838 | NM_024644 | HS chromosome 14 open reading frame 169 (C14orf169), mRNA. |
| XG | exonic | SEQ ID 839 | NM_001141919 | HS Xg blood group (XG), tv2, mRNA. |
| XG | exonic | SEQ ID 840 | NM_175569 | HS Xg blood group (XG), tv1, mRNA. |
| XG | exonic | SEQ ID 841 | NM_001141920 | HS Xg blood group (XG), tv3, mRNA. |
| BCMO1 | exonic | SEQ ID 842 | NM_017429 | HS beta-carotene 15,15'-monooxygenase 1 (BCMO1), mRNA. |
| CD99 | exonic | SEQ ID 843 | NM_002414 | HS CD99 molecule (CD99), tv1, mRNA. |
| CD99 | exonic | SEQ ID 844 | NM_001122898 | HS CD99 molecule (CD99), tv2, mRNA. |
| CD99P1 | exonic | SEQ ID 845 | NR_033381 | HS CD99 molecule pseudogene 1 (CD99P1), tv2, non-coding RNA. |
| CD99P1 | exonic | SEQ ID 846 | NR_033380 | HS CD99 molecule pseudogene 1 (CD99P1), tv1, non-coding RNA. |
| XGPY2 | exonic | SEQ ID 847 | NR_003254 | HS Xg pseudogene, Y-linked 2 (XGPY2), non-coding RNA. |
| ARSE | exonic | SEQ ID 848 | NM_000047 | HS arylsulfatase E (chondrodysplasia punctata 1) (ARSE), mRNA. |
| ARSF | exonic | SEQ ID 849 | NM_004042 | HS arylsulfatase F (ARSF), tv1, mRNA. |
| ARSF | exonic | SEQ ID 850 | NM_001201539 | HS arylsulfatase F (ARSF), tv3, mRNA. |
| ARSF | exonic | SEQ ID 851 | NM_001201538 | HS arylsulfatase F (ARSF), tv2, mRNA. |
| ARSD | exonic | SEQ ID 852 | NM_001669 | HS arylsulfatase D (ARSD), mRNA. |
| ARSH | exonic | SEQ ID 853 | NM_001011719 | HS arylsulfatase family, member H (ARSH), mRNA. |
| ADCY9 | exonic | SEQ ID 854 | NM_001116 | HS adenylate cyclase 9 (ADCY9), mRNA. |
| TRAP1 | exonic | SEQ ID 855 | NM_016292 | HS TNF receptor-associated protein 1 (TRAP1), nuclear gene encoding mitochondrial protein, tv1, mRNA. |
| NLRC3 | exonic | SEQ ID 856 | NM_178844 | HS NLR family, CARD domain containing 3 (NLRC3), mRNA. |
| ANKS3 | exonic | SEQ ID 857 | NR_040252 | HS ankyrin repeat and sterile alpha motif domain containing 3 (ANKS3), tv3, non-coding RNA. |
| SEC14L5 | exonic | SEQ ID 858 | NM_014692 | HS SEC14-like 5 (S. cerevisiae) (SEC14L5), mRNA. |
| ANKS3 | exonic | SEQ ID 859 | NM_133450 | HS ankyrin repeat and sterile alpha motif domain containing 3 (ANKS3), tv1, mRNA. |
| NMRAL1 | exonic | SEQ ID 860 | NM_020677 | HS NmrA-like family domain containing 1 (NMRAL1), mRNA. |
| UBN1 | exonic | SEQ ID 861 | NM_016936 | HS ubinuclein 1 (UBN1), tv1, mRNA. |
| UBN1 | exonic | SEQ ID 862 | NM_001079514 | HS ubinuclein 1 (UBN1), tv2, mRNA. |
| GLIS2 | exonic | SEQ ID 863 | NM_032575 | HS GLIS family zinc finger 2 (GLIS2), mRNA. |
| ANKS3 | exonic | SEQ ID 864 | NM_001242929 | HS ankyrin repeat and sterile alpha motif domain containing 3 (ANKS3), tv2, mRNA. |
| MTRNR2L4 | exonic | SEQ ID 865 | NM_001190476 | HS MT-RNR2-like 4 (MTRNR2L4), mRNA. |
| ZSCAN32/ZNF434 | exonic | SEQ ID 866 | NM_017810 | HS zinc finger and SCAN domain containing 32 (ZSCAN32), mRNA. |
| ZNF174 | exonic | SEQ ID 867 | NM_003450 | HS zinc finger protein 174 (ZNF174), tv1, mRNA. |
| ZNF174 | exonic | SEQ ID 868 | NM_001032292 | HS zinc finger protein 174 (ZNF174), tv2, mRNA. |
| CLUAP1 | exonic | SEQ ID 869 | NM_015041 | HS clusterin associated protein 1 (CLUAP1), tv1, mRNA. |
| NAA60 | exonic | SEQ ID 870 | NM_024845 | HS N(alpha)-acetyltransferase 60, NatF catalytic subunit (NAA60), tv2, mRNA. |
| NAA60 | exonic | SEQ ID 871 | NM_001083600 | HS N(alpha)-acetyltransferase 60, NatF catalytic subunit (NAA60), tv3, mRNA. |
| CLUAP1 | exonic | SEQ ID 872 | NM_024793 | HS clusterin associated protein 1 (CLUAP1), tv2, mRNA. |
| C16orf90 | exonic | SEQ ID 873 | NM_001080524 | HS chromosome 16 open reading frame 90 (C16orf90), mRNA. |
| ZNF597 | exonic | SEQ ID 874 | NM_152457 | HS zinc finger protein 597 (ZNF597), mRNA. |
| NAA60 | exonic | SEQ ID 875 | NM_001083601 | HS N(alpha)-acetyltransferase 60, NatF catalytic subunit (NAA60), tv1, mRNA. |
| DNASE1 | exonic | SEQ ID 876 | NM_005223 | HS deoxyribonuclease I (DNASE1), mRNA. |
| SLX4 | exonic | SEQ ID 877 | NM_032444 | HS SLX4 structure-specific endonuclease subunit homolog (S. cerevisiae) (SLX4), mRNA. |
| TFAP4 | exonic | SEQ ID 878 | NM_003223 | HS transcription factor AP-4 (activating enhancer binding protein 4) (TFAP4), mRNA. |
| LOC100507501 | exonic | SEQ ID 879 | NR_039999 | HS uncharacterized LOC100507501 (LOC100507501), non-coding RNA. |
| VASN | exonic | SEQ ID 880 | NM_138440 | HS vasorin (VASN), mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| PAM16 | exonic | SEQ ID 881 | NM_016069 | HS presequence translocase-associated motor 16 homolog (*S. cerevisiae*) (PAM16), nuclear gene encoding mitochondrial protein, mRNA. |
| CORO7-PAM16 | exonic | SEQ ID 882 | NM_001201479 | HS CORO7-PAM16 readthrough (CORO7-PAM16), mRNA. |
| CORO7 | exonic | SEQ ID 883 | NM_001201473 | HS coronin 7 (CORO7), tv3, mRNA. |
| CORO7 | exonic | SEQ ID 884 | NM_001201472 | HS coronin 7 (CORO7), tv2, mRNA. |
| DNAJA3 | exonic | SEQ ID 885 | NM_001135110 | HS DnaJ (Hsp40) homolog, subfamily A, member 3 (DNAJA3), nuclear gene encoding mitochondrial protein, tv2, mRNA. |
| CORO7 | exonic | SEQ ID 886 | NM_024535 | HS coronin 7 (CORO7), tv1, mRNA. |
| DNAJA3 | exonic | SEQ ID 887 | NM_005147 | HS DnaJ (Hsp40) homolog, subfamily A, member 3 (DNAJA3), nuclear gene encoding mitochondrial protein, tv1, mRNA. |
| CDIP1/C16orf5 | exonic | SEQ ID 888 | NM_013399 | HS cell death-inducing p53 target 1 (CDIP1), tv2, mRNA. |
| HMOX2 | exonic | SEQ ID 889 | NM_001127206 | HS heme oxygenase (decycling) 2 (HMOX2), tv4, mRNA. |
| CDIP1/C16orf5 | exonic | SEQ ID 890 | NM_001199056 | HS cell death-inducing p53 target 1 (CDIP1), tv4, mRNA. |
| CDIP1/C16orf5 | exonic | SEQ ID 891 | NM_001199055 | HS cell death-inducing p53 target 1 (CDIP1), tv3, mRNA. |
| CDIP1/C16orf5 | exonic | SEQ ID 892 | NM_001199054 | HS cell death-inducing p53 target 1 (CDIP1), tv1, mRNA. |
| HMOX2 | exonic | SEQ ID 893 | NM_001127205 | HS heme oxygenase (decycling) 2 (HMOX2), tv2, mRNA. |
| HMOX2 | exonic | SEQ ID 894 | NM_002134 | HS heme oxygenase (decycling) 2 (HMOX2), tv3, mRNA. |
| HMOX2 | exonic | SEQ ID 895 | NM_001127204 | HS heme oxygenase (decycling) 2 (HMOX2), tv1, mRNA. |
| NUDT16L1 | exonic | SEQ ID 896 | NM_001193452 | HS nudix (nucleoside diphosphate linked moiety X)-type motif 16-like 1 (NUDT16L1), tv2, mRNA. |
| NUDT16L1 | exonic | SEQ ID 897 | NM_032349 | HS nudix (nucleoside diphosphate linked moiety X)-type motif 16-like 1 (NUDT16L1), tv1, mRNA. |
| MGRN1 | exonic | SEQ ID 898 | NM_001142291 | HS mahogunin ring finger 1, E3 ubiquitin protein ligase (MGRN1), tv4, mRNA. |
| MGRN1 | exonic | SEQ ID 899 | NM_015246 | HS mahogunin ring finger 1, E3 ubiquitin protein ligase (MGRN1), tv1, mRNA. |
| MGRN1 | exonic | SEQ ID 900 | NM_001142289 | HS mahogunin ring finger 1, E3 ubiquitin protein ligase (MGRN1), tv2, mRNA. |
| MGRN1 | exonic | SEQ ID 901 | NM_001142290 | HS mahogunin ring finger 1, E3 ubiquitin protein ligase (MGRN1), tv3, mRNA. |
| UBALD1/FAM100A | exonic | SEQ ID 902 | NM_145253 | HS UBA-like domain containing 1 (UBALD1), mRNA. |
| C16orf71 | exonic | SEQ ID 903 | NM_139170 | HS chromosome 16 open reading frame 71 (C16orf71), mRNA. |
| ROGDI | exonic | SEQ ID 904 | NM_024589 | HS rogdi homolog (*Drosophila*) (ROGDI), tv1, mRNA. |
| LOC440335 | exonic | SEQ ID 905 | NM_001253794 | HS uncharacterized LOC440335 (LOC440335), tv4, mRNA. |
| SEPT12 | exonic | SEQ ID 906 | NM_144605 | HS septin 12 (SEPT12), tv2, mRNA. |
| ROGDI | exonic | SEQ ID 907 | NR_046480 | HS rogdi homolog (*Drosophila*) (ROGDI), tv2, non-coding RNA. |
| SEPT12 | exonic | SEQ ID 908 | NM_001154458 | HS septin 12 (SEPT12), tv1, mRNA. |
| GLYR1 | exonic | SEQ ID 909 | NM_032569 | HS glyoxylate reductase 1 homolog (*Arabidopsis*) (GLYR1), mRNA. |
| ZNF500 | exonic | SEQ ID 910 | NM_021646 | HS zinc finger protein 500 (ZNF500), mRNA. |
| LOC440335 | exonic | SEQ ID 911 | NM_001253791 | HS uncharacterized LOC440335 (LOC440335), tv2, mRNA. |
| LOC440335 | exonic | SEQ ID 912 | NM_001253790 | HS uncharacterized LOC440335 (LOC440335), tv1, mRNA. |
| LOC440335 | exonic | SEQ ID 913 | NM_001253793 | HS uncharacterized LOC440335 (LOC440335), tv3, mRNA. |
| PPL | exonic | SEQ ID 914 | NM_002705 | HS periplakin (PPL), mRNA. |
| ALG1 | exonic | SEQ ID 915 | NM_019109 | HS asparagine-linked glycosylation 1, beta-1,4-mannosyltransferase homolog (*S. cerevisiae*) (ALG1), mRNA. |
| NAGPA | exonic | SEQ ID 916 | NM_016256 | HS N-acetylglucosamine-1-phosphodiester alpha-N-acetylglucosaminidase (NAGPA), mRNA. |
| NAGPA-AS1 | exonic | SEQ ID 917 | NR_038913 | HS NAGPA antisense RNA 1 (NAGPA-AS1), non-coding RNA. |
| SNUPN | exonic | SEQ ID 918 | NM_001042588 | HS snurportin 1 (SNUPN), tv3, mRNA. |
| SNUPN | exonic | SEQ ID 919 | NM_005701 | HS snurportin 1 (SNUPN), tv1, mRNA. |
| SNUPN | exonic | SEQ ID 920 | NM_001042581 | HS snurportin 1 (SNUPN), tv2, mRNA. |
| SIN3A | exonic | SEQ ID 921 | NM_001145357 | HS SIN3 transcription regulator homolog A (yeast) (SIN3A), tv3, mRNA. |
| SIN3A | exonic | SEQ ID 922 | NM_001145358 | HS SIN3 transcription regulator homolog A (yeast) (SIN3A), tv1, mRNA. |
| MAN2C1 | exonic | SEQ ID 923 | NM_006715 | HS mannosidase, alpha, class 2C, member 1 (MAN2C1), tv1, mRNA. |
| SIN3A | exonic | SEQ ID 924 | NM_015477 | HS SIN3 transcription regulator homolog A (yeast) (SIN3A), tv2, mRNA. |
| MAN2C1 | exonic | SEQ ID 925 | NM_001256494 | HS mannosidase, alpha, class 2C, member 1 (MAN2C1), tv2, mRNA. |
| MAN2C1 | exonic | SEQ ID 926 | NM_001256496 | HS mannosidase, alpha, class 2C, member 1 (MAN2C1), tv4, mRNA. |
| MAN2C1 | exonic | SEQ ID 927 | NM_001256495 | HS mannosidase, alpha, class 2C, member 1 (MAN2C1), tv3, mRNA. |
| IMP3 | exonic | SEQ ID 928 | NM_018285 | HS IMP3, U3 small nucleolar ribonucleoprotein, homolog (yeast) (IMP3), mRNA. |
| CSPG4 | exonic | SEQ ID 929 | NM_001897 | HS chondroitin sulfate proteoglycan 4 (CSPG4), mRNA. |
| SNX33 | exonic | SEQ ID 930 | NM_153271 | HS sorting nexin 33 (SNX33), mRNA. |
| CYP1A1 | exonic | SEQ ID 931 | NM_000499 | HS cytochrome P450, family 1, subfamily A, polypeptide 1 (CYP1A1), mRNA. |
| ARHGAP21 | exonic | SEQ ID 932 | NM_020824 | HS Rho GTPase activating protein 21 (ARHGAP21), mRNA. |
| NEO1 | exonic | SEQ ID 933 | NM_002499 | HS neogenin 1 (NEO1), tv1, mRNA. |
| NEO1 | exonic | SEQ ID 934 | NM_001172624 | HS neogenin 1 (NEO1), tv3, mRNA. |
| NEO1 | exonic | SEQ ID 935 | NM_001172623 | HS neogenin 1 (NEO1), tv2, mRNA. |
| TXLNB | exonic | SEQ ID 936 | NM_153235 | HS taxilin beta (TXLNB), mRNA. |
| ZAN | exonic | SEQ ID 937 | NM_003386 | HS zonadhesin (ZAN), tv3, mRNA. |
| ZAN | exonic | SEQ ID 938 | NM_173059 | HS zonadhesin (ZAN), tv6, mRNA. |
| LCE1D | exonic | SEQ ID 939 | NM_178352 | HS late cornified envelope 1D (LCE1D), mRNA. |
| LCE1C | exonic | SEQ ID 940 | NM_178351 | HS late cornified envelope 1C (LCE1C), tv1, mRNA. |
| LCE1E | exonic | SEQ ID 941 | NM_178353 | HS late cornified envelope 1E (LCE1E), mRNA. |
| CCDC33 | exonic | SEQ ID 942 | NM_025055 | HS coiled-coil domain containing 33 (CCDC33), mRNA. |
| GRAMD2 | exonic | SEQ ID 943 | NM_001012642 | HS GRAM domain containing 2 (GRAMD2), mRNA. |
| MYO9A | exonic | SEQ ID 944 | NM_006901 | HS myosin IXA (MYO9A), mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| THSD4 | exonic | SEQ ID 945 | NM_024817 | HS thrombospondin, type I, domain containing 4 (THSD4), mRNA. |
| BBS4 | exonic | SEQ ID 946 | NM_033028 | HS Bardet-Biedl syndrome 4 (BBS4), tv1, mRNA. |
| CELF6 | exonic | SEQ ID 947 | NM_001172684 | HS CUGBP, Elav-like family member 6 (CELF6), tv2, mRNA. |
| CELF6 | exonic | SEQ ID 948 | NM_052840 | HS CUGBP, Elav-like family member 6 (CELF6), tv1, mRNA. |
| CELF6 | exonic | SEQ ID 949 | NM_001172685 | HS CUGBP, Elav-like family member 6 (CELF6), tv3, mRNA. |
| BBS4 | exonic | SEQ ID 950 | NM_001252678 | HS Bardet-Biedl syndrome 4 (BBS4), tv2, mRNA. |
| ARIH1 | exonic | SEQ ID 951 | NM_005744 | HS ariadne homolog, ubiquitin-conjugating enzyme E2 binding protein, 1 (*Drosophila*) (ARIH1), mRNA. |
| BBS4 | exonic | SEQ ID 952 | NR_045566 | HS Bardet-Biedl syndrome 4 (BBS4), tv4, non-coding RNA. |
| BBS4 | exonic | SEQ ID 953 | NR_045565 | HS Bardet-Biedl syndrome 4 (BBS4), tv3, non-coding RNA. |
| NPTN | exonic | SEQ ID 954 | NM_001161364 | HS neuroplastin (NPTN), tvd, mRNA. |
| PML | exonic | SEQ ID 955 | NM_002675 | HS promyelocytic leukemia (PML), tv6, mRNA. |
| TBC1D21 | exonic | SEQ ID 956 | NM_153356 | HS TBC1 domain family, member 21 (TBC1D21), mRNA. |
| PML | exonic | SEQ ID 957 | NM_033240 | HS promyelocytic leukemia (PML), tv2, mRNA. |
| PML | exonic | SEQ ID 958 | NM_033239 | HS promyelocytic leukemia (PML), tv9, mRNA. |
| C15orf60 | exonic | SEQ ID 959 | NM_001042367 | HS chromosome 15 open reading frame 60 (C15orf60), mRNA. |
| PML | exonic | SEQ ID 960 | NM_033250 | HS promyelocytic leukemia (PML), tv11, mRNA. |
| PML | exonic | SEQ ID 961 | NM_033249 | HS promyelocytic leukemia (PML), tv10, mRNA. |
| PML | exonic | SEQ ID 962 | NM_033247 | HS promyelocytic leukemia (PML), tv8, mRNA. |
| PML | exonic | SEQ ID 963 | NM_033246 | HS promyelocytic leukemia (PML), tv7, mRNA. |
| PML | exonic | SEQ ID 964 | NM_033244 | HS promyelocytic leukemia (PML), tv5, mRNA. |
| NPTN | exonic | SEQ ID 965 | NM_012428 | HS neuroplastin (NPTN), tvb, mRNA. |
| PML | exonic | SEQ ID 966 | NM_033238 | HS promyelocytic leukemia (PML), tv1, mRNA. |
| NPTN | exonic | SEQ ID 967 | NM_017455 | HS neuroplastin (NPTN), tva, mRNA. |
| NPTN | exonic | SEQ ID 968 | NM_001161363 | HS neuroplastin (NPTN), tvc, mRNA. |
| HCN4 | exonic | SEQ ID 969 | NM_005477 | HS hyperpolarization activated cyclic nucleotide-gated potassium channel 4 (HCN4), mRNA. |
| C15orf59 | exonic | SEQ ID 970 | NM_001039614 | HS chromosome 15 open reading frame 59 (C15orf59), mRNA. |
| CSK | exonic | SEQ ID 971 | NM_001127190 | HS c-src tyrosine kinase (CSK), tv2, mRNA. |
| COX5A | exonic | SEQ ID 972 | NM_004255 | HS cytochrome c oxidase subunit Va (COX5A), nuclear gene encoding mitochondrial protein, mRNA. |
| EDC3 | exonic | SEQ ID 973 | NM_001142444 | HS enhancer of mRNA decapping 3 homolog (*S. cerevisiae*) (EDC3), tv2, mRNA. |
| EDC3 | exonic | SEQ ID 974 | NM_001142443 | HS enhancer of mRNA decapping 3 homolog (*S. cerevisiae*) (EDC3), tv1, mRNA. |
| CSK | exonic | SEQ ID 975 | NM_004383 | HS c-src tyrosine kinase (CSK), tv1, mRNA. |
| EDC3 | exonic | SEQ ID 976 | NM_025083 | HS enhancer of mRNA decapping 3 homolog (*S. cerevisiae*) (EDC3), tv3, mRNA. |
| NR2E3 | exonic | SEQ ID 977 | NM_016346 | HS nuclear receptor subfamily 2, group E, member 3 (NR2E3), tv1, mRNA. |
| NR2E3 | exonic | SEQ ID 978 | NM_014249 | HS nuclear receptor subfamily 2, group E, member 3 (NR2E3), tv2, mRNA. |
| SENP8 | exonic | SEQ ID 979 | NM_001172109 | HS SUMO/sentrin specific peptidase family member 8 (SENP8), tv3, mRNA. |
| SENP8 | exonic | SEQ ID 980 | NM_001172111 | HS SUMO/sentrin specific peptidase family member 8 (SENP8), tv5, mRNA. |
| SENP8 | exonic | SEQ ID 981 | NM_145204 | HS SUMO/sentrin specific peptidase family member 8 (SENP8), tv2, mRNA. |
| SENP8 | exonic | SEQ ID 982 | NM_001172110 | HS SUMO/sentrin specific peptidase family member 8 (SENP8), tv4, mRNA. |
| SENP8 | exonic | SEQ ID 983 | NM_001166340 | HS SUMO/sentrin specific peptidase family member 8 (SENP8), tv1, mRNA. |
| PKM | exonic | SEQ ID 984 | NM_002654 | HS pyruvate kinase, muscle (PKM), tv1, mRNA. |
| PKM | exonic | SEQ ID 985 | NM_001206796 | HS pyruvate kinase, muscle (PKM), tv4, mRNA. |
| PARP6 | exonic | SEQ ID 986 | NM_020214 | HS poly (ADP-ribose) polymerase family, member 6 (PARP6), mRNA. |
| PKM | exonic | SEQ ID 987 | NM_182471 | HS pyruvate kinase, muscle (PKM), tv3, mRNA. |
| PKM | exonic | SEQ ID 988 | NM_182470 | HS pyruvate kinase, muscle (PKM), tv2, mRNA. |
| PKM | exonic | SEQ ID 989 | NM_001206799 | HS pyruvate kinase, muscle (PKM), tv7, mRNA. |
| PKM | exonic | SEQ ID 990 | NM_001206798 | HS pyruvate kinase, muscle (PKM), tv6, mRNA. |
| PKM | exonic | SEQ ID 991 | NM_001206797 | HS pyruvate kinase, muscle (PKM), tv5, mRNA. |
| HEXA-AS1 | exonic | SEQ ID 992 | NR_027262 | HS HEXA antisense RNA 1 (HEXA-AS1), non-coding RNA. |
| HEXA | exonic | SEQ ID 993 | NM_000520 | HS hexosaminidase A (alpha polypeptide) (HEXA), mRNA. |
| TMEM202 | exonic | SEQ ID 994 | NM_001080462 | HS transmembrane protein 202 (TMEM202), mRNA. |
| HIGD2B | exonic | SEQ ID 995 | NR_002780 | HS HIG1 hypoxia inducible domain family, member 2B (HIGD2B), non-coding RNA. |
| GOLGA6B | exonic | SEQ ID 996 | NM_018652 | HS golgin A6 family, member B (GOLGA6B), mRNA. |
| MIR630 | exonic | SEQ ID 997 | NR_030359 | HS microRNA 630 (MIR630), microRNA. |
| ADPGK | exonic | SEQ ID 998 | NR_023319 | HS ADP-dependent glucokinase (ADPGK), tv3, non-coding RNA. |
| ADPGK | exonic | SEQ ID 999 | NR_023318 | HS ADP-dependent glucokinase (ADPGK), tv2, non-coding RNA. |
| ADPGK | exonic | SEQ ID 1000 | NM_031284 | HS ADP-dependent glucokinase (ADPGK), tv1, mRNA. |
| ADPGK-AS1 | exonic | SEQ ID 1001 | NR_040107 | HS ADPGK antisense RNA 1 (ADPGK-AS1), non-coding RNA. |
| CD276 | exonic | SEQ ID 1002 | NM_001024736 | HS CD276 molecule (CD276), tv1, mRNA. |
| CD276 | exonic | SEQ ID 1003 | NM_025240 | HS CD276 molecule (CD276), tv2, mRNA. |
| STOML1 | exonic | SEQ ID 1004 | NM_001256677 | HS stomatin (EPB72)-like 1 (STOML1), tv7, mRNA. |
| STOML1 | exonic | SEQ ID 1005 | NM_001256673 | HS stomatin (EPB72)-like 1 (STOML1), tv3, mRNA. |
| STOML1 | exonic | SEQ ID 1006 | NM_001256672 | HS stomatin (EPB72)-like 1 (STOML1), tv2, mRNA. |
| LOXL1 | exonic | SEQ ID 1007 | NM_005576 | HS lysyl oxidase-like 1 (LOXL1), mRNA. |
| LOXL1-AS1 | exonic | SEQ ID 1008 | NR_040066 | HS LOXL1 antisense RNA 1 (LOXL1-AS1), tv1, non-coding RNA. |
| STOML1 | exonic | SEQ ID 1009 | NM_001256676 | HS stomatin (EPB72)-like 1 (STOML1), tv6, mRNA. |
| STOML1 | exonic | SEQ ID 1010 | NM_001256675 | HS stomatin (EPB72)-like 1 (STOML1), tv5, mRNA. |
| STOML1 | exonic | SEQ ID 1011 | NM_001256674 | HS stomatin (EPB72)-like 1 (STOML1), tv4, mRNA. |
| LOXL1-AS1 | exonic | SEQ ID 1012 | NR_040070 | HS LOXL1 antisense RNA 1 (LOXL1-AS1), tv5, non-coding RNA. |
| STOML1 | exonic | SEQ ID 1013 | NM_004809 | HS stomatin (EPB72)-like 1 (STOML1), tv1, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| LOXL1-AS1 | exonic | SEQ ID 1014 | NR_040069 | HS LOXL1 antisense RNA 1 (LOXL1-AS1), tv4, non-coding RNA. |
| LOXL1-AS1 | exonic | SEQ ID 1015 | NR_040068 | HS LOXL1 antisense RNA 1 (LOXL1-AS1), tv3, non-coding RNA. |
| LOXL1-AS1 | exonic | SEQ ID 1016 | NR_040067 | HS LOXL1 antisense RNA 1 (LOXL1-AS1), tv2, non-coding RNA. |
| ISLR2 | exonic | SEQ ID 1017 | NM_020851 | HS immunoglobulin superfamily containing leucine-rich repeat 2 (ISLR2), tv2, mRNA. |
| LOC283731 | exonic | SEQ ID 1018 | NR_027073 | HS uncharacterized LOC283731 (LOC283731), non-coding RNA. |
| ISLR2 | exonic | SEQ ID 1019 | NM_001130138 | HS immunoglobulin superfamily containing leucine-rich repeat 2 (ISLR2), tv4, mRNA. |
| ISLR2 | exonic | SEQ ID 1020 | NM_001130137 | HS immunoglobulin superfamily containing leucine-rich repeat 2 (ISLR2), tv3, mRNA. |
| ISLR2 | exonic | SEQ ID 1021 | NM_001130136 | HS immunoglobulin superfamily containing leucine-rich repeat 2 (ISLR2), tv1, mRNA. |
| GOLGA6A | exonic | SEQ ID 1022 | NM_001038640 | HS golgin A6 family, member A (GOLGA6A), mRNA. |
| STRA6 | exonic | SEQ ID 1023 | NM_001199041 | HS stimulated by retinoic acid 6 (STRA6), tv7, mRNA. |
| STRA6 | exonic | SEQ ID 1024 | NM_001142619 | HS stimulated by retinoic acid 6 (STRA6), tv4, mRNA. |
| STRA6 | exonic | SEQ ID 1025 | NM_001199040 | HS stimulated by retinoic acid 6 (STRA6), tv6, mRNA. |
| STRA6 | exonic | SEQ ID 1026 | NM_001142618 | HS stimulated by retinoic acid 6 (STRA6), tv3, mRNA. |
| STRA6 | exonic | SEQ ID 1027 | NM_001142617 | HS stimulated by retinoic acid 6 (STRA6), tv1, mRNA. |
| STRA6 | exonic | SEQ ID 1028 | NM_022369 | HS stimulated by retinoic acid 6 (STRA6), tv2, mRNA. |
| ISLR | exonic | SEQ ID 1029 | NM_201526 | HS immunoglobulin superfamily containing leucine-rich repeat (ISLR), tv2, mRNA. |
| ISLR | exonic | SEQ ID 1030 | NM_005545 | HS immunoglobulin superfamily containing leucine-rich repeat (ISLR), tv1, mRNA. |
| STRA6 | exonic | SEQ ID 1031 | NM_001142620 | HS stimulated by retinoic acid 6 (STRA6), tv5, mRNA. |
| STRA6 | exonic | SEQ ID 1032 | NM_001199042 | HS stimulated by retinoic acid 6 (STRA6), tv8, mRNA. |
| CYP11A1 | exonic | SEQ ID 1033 | NM_000781 | HS cytochrome P450, family 11, subfamily A, polypeptide 1 (CYP11A1), nuclear gene encoding mitochondrial protein, tv1, mRNA. |
| CYP11A1 | exonic | SEQ ID 1034 | NM_001099773 | HS cytochrome P450, family 11, subfamily A, polypeptide 1 (CYP11A1), tv2, mRNA. |
| CCDC33 | exonic | SEQ ID 1035 | NM_182791 | HS coiled-coil domain containing 33 (CCDC33), tv2, mRNA. |
| LOC729739 | exonic | SEQ ID 1036 | NR_045207 | HS peptidylprolyl isomerase A (cyclophilin A) pseudogene (LOC729739), non-coding RNA. |
| SEMA7A | exonic | SEQ ID 1037 | NM_001146030 | HS semaphorin 7A, GPI membrane anchor (John Milton Hagen blood group) (SEMA7A), tv3, mRNA. |
| SEMA7A | exonic | SEQ ID 1038 | NM_001146029 | HS semaphorin 7A, GPI membrane anchor (John Milton Hagen blood group) (SEMA7A), tv2, mRNA. |
| SEMA7A | exonic | SEQ ID 1039 | NM_003612 | HS semaphorin 7A, GPI membrane anchor (John Milton Hagen blood group) (SEMA7A), tv1, mRNA. |
| LOC440288 | exonic | SEQ ID 1040 | NR_038449 | HS uncharacterized LOC440288 (LOC440288), tv2, non-coding RNA. |
| LOC440288 | exonic | SEQ ID 1041 | NR_038448 | HS uncharacterized LOC440288 (LOC440288), tv1, non-coding RNA. |
| UBL7 | exonic | SEQ ID 1042 | NM_032907 | HS ubiquitin-like 7 (bone marrow stromal cell-derived) (UBL7), tv1, mRNA. |
| UBL7 | exonic | SEQ ID 1043 | NM_201265 | HS ubiquitin-like 7 (bone marrow stromal cell-derived) (UBL7), tv2, mRNA. |
| CLK3 | exonic | SEQ ID 1044 | NM_001130028 | HS CDC-like kinase 3 (CLK3), tv1, mRNA. |
| ARID3B | exonic | SEQ ID 1045 | NM_006465 | HS AT rich interactive domain 3B (BRIGHT-like) (ARID3B), mRNA. |
| CLK3 | exonic | SEQ ID 1046 | NM_003992 | HS CDC-like kinase 3 (CLK3), tv2, mRNA. |
| CYP1A2 | exonic | SEQ ID 1047 | NM_000761 | HS cytochrome P450, family 1, subfamily A, polypeptide 2 (CYP1A2), mRNA. |
| MIR4513 | exonic | SEQ ID 1048 | NR_039738 | HS microRNA 4513 (MIR4513), microRNA. |
| FAM219B | exonic | SEQ ID 1049 | NM_020447 | HS family with sequence similarity 219, member B (FAM219B), mRNA. |
| CPLX3 | exonic | SEQ ID 1050 | NM_001030005 | HS complexin 3 (CPLX3), mRNA. |
| MPI | exonic | SEQ ID 1051 | NM_002435 | HS mannose phosphate isomerase (MPI), mRNA. |
| LMAN1L | exonic | SEQ ID 1052 | NM_021819 | HS lectin, mannose-binding, 1 like (LMAN1L), mRNA. |
| ULK3 | exonic | SEQ ID 1053 | NM_001099436 | HS unc-51-like kinase 3 (C. elegans) (ULK3), mRNA. |
| SCAMP2 | exonic | SEQ ID 1054 | NM_005697 | HS secretory carrier membrane protein 2 (SCAMP2), mRNA. |
| RPP25 | exonic | SEQ ID 1055 | NM_017793 | HS ribonuclease P/MRP 25 kDa subunit (RPP25), mRNA. |
| SCAMP5 | exonic | SEQ ID 1056 | NM_001178112 | HS secretory carrier membrane protein 5 (SCAMP5), tv2, mRNA. |
| SCAMP5 | exonic | SEQ ID 1057 | NM_138967 | HS secretory carrier membrane protein 5 (SCAMP5), tv3, mRNA. |
| SCAMP5 | exonic | SEQ ID 1058 | NR_033660 | HS secretory carrier membrane protein 5 (SCAMP5), tv4, non-coding RNA. |
| PPCDC | exonic | SEQ ID 1059 | NM_021823 | HS phosphopantothenoylcysteine decarboxylase (PPCDC), mRNA. |
| SCAMP5 | exonic | SEQ ID 1060 | NM_001178111 | HS secretory carrier membrane protein 5 (SCAMP5), tv1, mRNA. |
| GOLGA6C | exonic | SEQ ID 1061 | NM_001164404 | HS golgin A6 family, member C (GOLGA6C), mRNA. |
| GOLGA6D | exonic | SEQ ID 1062 | NM_001145224 | HS golgin A6 family, member D (GOLGA6D), mRNA. |
| C15orf39 | exonic | SEQ ID 1063 | NM_015492 | HS chromosome 15 open reading frame 39 (C15orf39), mRNA. |
| NEIL1 | exonic | SEQ ID 1064 | NM_001256552 | HS nei endonuclease VIII-like 1 (E. coli) (NEIL1), tv1, mRNA. |
| NEIL1 | exonic | SEQ ID 1065 | NM_024608 | HS nei endonuclease VIII-like 1 (E. coli) (NEIL1), tv2, mRNA. |
| MIR631 | exonic | SEQ ID 1066 | NR_030360 | HS microRNA 631 (MIR631), microRNA. |
| COMMD4 | exonic | SEQ ID 1067 | NM_017828 | HS COMM domain containing 4 (COMMD4), mRNA. |
| NEIL1 | exonic | SEQ ID 1068 | NR_046311 | HS nei endonuclease VIII-like 1 (E. coli) (NEIL1), tv3, non-coding RNA. |
| PTPN9 | exonic | SEQ ID 1069 | NM_002833 | HS protein tyrosine phosphatase, non-receptor type 9 (PTPN9), mRNA. |
| MIR4313 | exonic | SEQ ID 1070 | NR_036198 | HS microRNA 4313 (MIR4313), microRNA. |
| ODF3L1 | exonic | SEQ ID 1071 | NM_175881 | HS outer dense fiber of sperm tails 3-like 1 (ODF3L1), mRNA. |
| DNM1P35 | exonic | SEQ ID 1072 | NR_024595 | HS DNM1 pseudogene 35 (DNM1P35), non-coding RNA. |
| STARD3 | exonic | SEQ ID 1073 | NM_001165938 | HS StAR-related lipid transfer (START) domain containing 3 (STARD3), tv3, mRNA. |
| STARD3 | exonic | SEQ ID 1074 | NM_001165937 | HS StAR-related lipid transfer (START) domain containing 3 (STARD3), tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| STARD3 | exonic | SEQ ID 1075 | NM_006804 | HS StAR-related lipid transfer (START) domain containing 3 (STARD3), tv1, mRNA. |
| KLHL9 | exonic | SEQ ID 1076 | NM_018847 | HS kelch-like family member 9 (KLHL9), mRNA. |
| IFNA1 | exonic | SEQ ID 1077 | NM_024013 | HS interferon, alpha 1 (IFNA1), mRNA. |
| ATRNL1 | exonic | SEQ ID 1078 | NM_207303 | HS attractin-like 1 (ATRNL1), tv1, mRNA. |
| IFNA22P | exonic | SEQ ID 1079 | NR_036676 | HS interferon, alpha 22, pseudogene (IFNA22P), non-coding RNA. |
| SLIT2 | exonic | SEQ ID 1080 | NM_004787 | HS slit homolog 2 (*Drosophila*) (SLIT2), mRNA. |
| SLC38A6 | exonic | SEQ ID 1081 | NR_033344 | HS solute carrier family 38, member 6 (SLC38A6), tv3, non-coding RNA. |
| SLC38A6 | exonic | SEQ ID 1082 | NM_153811 | HS solute carrier family 38, member 6 (SLC38A6), tv2, mRNA. |
| SLC38A6 | exonic | SEQ ID 1083 | NM_001172702 | HS solute carrier family 38, member 6 (SLC38A6), tv1, mRNA. |
| BMX | exonic | SEQ ID 1084 | NM_203281 | HS BMX non-receptor tyrosine kinase (BMX), tv1, mRNA. |
| BMX | exonic | SEQ ID 1085 | NM_001721 | HS BMX non-receptor tyrosine kinase (BMX), tv2, mRNA. |
| ADAMTS5 | exonic | SEQ ID 1086 | NM_007038 | HS ADAM metallopeptidase with thrombospondin type 1 motif, 5 (ADAMTS5), mRNA. |
| WIZ | exonic | SEQ ID 1087 | NM_021241 | HS widely interspaced zinc finger motifs (WIZ), mRNA. |
| MIR1470 | exonic | SEQ ID 1088 | NR_031716 | HS microRNA 1470 (MIR1470), microRNA. |
| FBXO18 | exonic | SEQ ID 1089 | NM_001258452 | HS F-box protein, helicase, 18 (FBXO18), tv3, mRNA. |
| FBXO18 | exonic | SEQ ID 1090 | NM_001258453 | HS F-box protein, helicase, 18 (FBXO18), tv4, mRNA. |
| FBXO18 | exonic | SEQ ID 1091 | NM_032807 | HS F-box protein, helicase, 18 (FBXO18), tv1, mRNA. |
| FBXO18 | exonic | SEQ ID 1092 | NM_178150 | HS F-box protein, helicase, 18 (FBXO18), tv2, mRNA. |
| C6orf99 | exonic | SEQ ID 1093 | NM_001195032 | HS chromosome 6 open reading frame 99 (C6orf99), mRNA. |
| INO80D | exonic | SEQ ID 1094 | NM_017759 | HS INO80 complex subunit D (INO80D), mRNA. |
| LAMC3 | exonic | SEQ ID 1095 | NM_006059 | HS laminin, gamma 3 (LAMC3), mRNA. |
| HACE1 | exonic | SEQ ID 1096 | NM_020771 | HS HECT domain and ankyrin repeat containing E3 ubiquitin protein ligase 1 (HACE1), mRNA. |
| MIR99B | exonic | SEQ ID 1097 | NR_029843 | HS microRNA 99b (MIR99B), microRNA. |
| LINC00085 | exonic | SEQ ID 1098 | NR_024330 | HS long intergenic non-protein coding RNA 85 (LINC00085), non-coding RNA. |
| MIRLET7E | exonic | SEQ ID 1099 | NR_029482 | HS microRNA let-7e (MIRLET7E), microRNA. |
| MIR125A | exonic | SEQ ID 1100 | NR_029693 | HS microRNA 125a (MIR125A), microRNA. |
| ADAMTS9 | exonic | SEQ ID 1101 | NM_182920 | HS ADAM metallopeptidase with thrombospondin type 1 motif, 9 (ADAMTS9), mRNA. |
| ZRANB3 | exonic | SEQ ID 1102 | NM_032143 | HS zinc finger, RAN-binding domain containing 3 (ZRANB3), mRNA. |
| ALB | exonic | SEQ ID 1103 | NM_000477 | HS albumin (ALB), mRNA. |
| SLC24A2 | exonic | SEQ ID 1104 | NM_001193288 | HS solute carrier family 24 (sodium/potassium/calcium exchanger), member 2 (SLC24A2), tv2, mRNA. |
| SLC24A2 | exonic | SEQ ID 1105 | NM_020344 | HS solute carrier family 24 (sodium/potassium/calcium exchanger), member 2 (SLC24A2), tv1, mRNA. |
| OSTCP1 | exonic | SEQ ID 1106 | NR_028496 | HS oligosaccharyltransferase complex subunit pseudogene 1 (OSTCP1), non-coding RNA. |
| DPP6 | exonic | SEQ ID 1107 | NM_001936 | HS dipeptidyl-peptidase 6 (DPP6), tv2, mRNA. |
| DPP6 | exonic | SEQ ID 1108 | NM_001039350 | HS dipeptidyl-peptidase 6 (DPP6), tv3, mRNA. |
| DPP6 | exonic | SEQ ID 1109 | NM_130797 | HS dipeptidyl-peptidase 6 (DPP6), tv1, mRNA. |
| PAXIP1 | exonic | SEQ ID 1110 | NM_007349 | HS PAX interacting (with transcription-activation domain) protein 1 (PAXIP1), mRNA. |
| LOC100132707 | exonic | SEQ ID 1111 | NR_024476 | HS uncharacterized LOC100132707 (LOC100132707), tv1, non-coding RNA. |
| LOC100132707 | exonic | SEQ ID 1112 | NR_024477 | HS uncharacterized LOC100132707 (LOC100132707), tv2, non-coding RNA. |
| LOC202781 | exonic | SEQ ID 1113 | NR_028090 | HS uncharacterized LOC202781 (LOC202781), non-coding RNA. |
| HTR5A | exonic | SEQ ID 1114 | NM_024012 | HS 5-hydroxytryptamine (serotonin) receptor 5A, G protein-coupled (HTR5A), mRNA. |
| LOC100128264 | exonic | SEQ ID 1115 | NR_038945 | HS uncharacterized LOC100128264 (LOC100128264), non-coding RNA. |
| CDKN2B-AS1 | exonic | SEQ ID 1116 | NR_003529 | HS CDKN2B antisense RNA 1 (CDKN2B-AS1), tv1, non-coding RNA. |
| FOCAD | exonic | SEQ ID 1117 | NM_017794 | HS focadhesin (FOCAD), mRNA. |
| CDKN2B-AS1 | exonic | SEQ ID 1118 | NR_047543 | HS CDKN2B antisense RNA 1 (CDKN2B-AS1), tv3, non-coding RNA. |
| CDKN2B-AS1 | exonic | SEQ ID 1119 | NR_047542 | HS CDKN2B antisense RNA 1 (CDKN2B-AS1), tv12, non-coding RNA. |
| CDKN2B-AS1 | exonic | SEQ ID 1120 | NR_047541 | HS CDKN2B antisense RNA 1 (CDKN2B-AS1), tv11, non-coding RNA. |
| CDKN2B-AS1 | exonic | SEQ ID 1121 | NR_047540 | HS CDKN2B antisense RNA 1 (CDKN2B-AS1), tv10, non-coding RNA. |
| CDKN2B-AS1 | exonic | SEQ ID 1122 | NR_047539 | HS CDKN2B antisense RNA 1 (CDKN2B-AS1), tv9, non-coding RNA. |
| CDKN2B-AS1 | exonic | SEQ ID 1123 | NR_047538 | HS CDKN2B antisense RNA 1 (CDKN2B-AS1), tv8, non-coding RNA. |
| CDKN2B-AS1 | exonic | SEQ ID 1124 | NR_047537 | HS CDKN2B antisense RNA 1 (CDKN2B-AS1), tv7, non-coding RNA. |
| CDKN2B-AS1 | exonic | SEQ ID 1125 | NR_047536 | HS CDKN2B antisense RNA 1 (CDKN2B-AS1), tv6, non-coding RNA. |
| CDKN2B-AS1 | exonic | SEQ ID 1126 | NR_047535 | HS CDKN2B antisense RNA 1 (CDKN2B-AS1), tv5, non-coding RNA. |
| CDKN2B-AS1 | exonic | SEQ ID 1127 | NR_047534 | HS CDKN2B antisense RNA 1 (CDKN2B-AS1), tv4, non-coding RNA. |
| CDKN2B-AS1 | exonic | SEQ ID 1128 | NR_047533 | HS CDKN2B antisense RNA 1 (CDKN2B-AS1), tv13, non-coding RNA. |
| CDKN2B-AS1 | exonic | SEQ ID 1129 | NR_047532 | HS CDKN2B antisense RNA 1 (CDKN2B-AS1), tv2, non-coding RNA. |
| MLLT3 | exonic | SEQ ID 1130 | NM_004529 | HS myeloid/lymphoid or mixed-lineage leukemia (trithorax homolog, *Drosophila*); translocated to, 3 (MLLT3), mRNA. |
| MIR31HG | exonic | SEQ ID 1131 | NR_027054 | HS MIR31 host gene (non-protein coding) (MIR31HG), non-coding RNA. |
| FLJ35282 | exonic | SEQ ID 1132 | NR_038977 | HS uncharacterized LOC441389 (FLJ35282), non-coding RNA. |
| ELAVL2 | exonic | SEQ ID 1133 | NM_004432 | HS ELAV (embryonic lethal, abnormal vision, *Drosophila*)-like 2 (Hu antigen B) (ELAVL2), tv1, mRNA. |
| ELAVL2 | exonic | SEQ ID 1134 | NM_001171197 | HS ELAV (embryonic lethal, abnormal vision, *Drosophila*)-like 2 (Hu antigen B) (ELAVL2), tv3, mRNA. |
| ELAVL2 | exonic | SEQ ID 1135 | NM_001171195 | HS ELAV (embryonic lethal, abnormal vision, *Drosophila*)-like 2 (Hu antigen B) (ELAVL2), tv2, mRNA. |
| MIR4473 | exonic | SEQ ID 1136 | NR_039684 | HS microRNA 4473 (MIR4473), microRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| MIR4474 | exonic | SEQ ID 1137 | NR_039685 | HS microRNA 4474 (MIR4474), microRNA. |
| MIR491 | exonic | SEQ ID 1138 | NR_030166 | HS microRNA 491 (MIR491), microRNA. |
| IFNB1 | exonic | SEQ ID 1139 | NM_002176 | HS interferon, beta 1, fibroblast (IFNB1), mRNA. |
| PTPLAD2 | exonic | SEQ ID 1140 | NM_001010915 | HS protein tyrosine phosphatase-like A domain containing 2 (PTPLAD2), mRNA. |
| IFNA7 | exonic | SEQ ID 1141 | NM_021057 | HS interferon, alpha 7 (IFNA7), mRNA. |
| IFNA16 | exonic | SEQ ID 1142 | NM_002173 | HS interferon, alpha 16 (IFNA16), mRNA. |
| IFNA14 | exonic | SEQ ID 1143 | NM_002172 | HS interferon, alpha 14 (IFNA14), mRNA. |
| IFNA21 | exonic | SEQ ID 1144 | NM_002175 | HS interferon, alpha 21 (IFNA21), mRNA. |
| IFNA10 | exonic | SEQ ID 1145 | NM_002171 | HS interferon, alpha 10 (IFNA10), mRNA. |
| IFNW1 | exonic | SEQ ID 1146 | NM_002177 | HS interferon, omega 1 (IFNW1), mRNA. |
| IFNA4 | exonic | SEQ ID 1147 | NM_021068 | HS interferon, alpha 4 (IFNA4), mRNA. |
| IFNA17 | exonic | SEQ ID 1148 | NM_021268 | HS interferon, alpha 17 (IFNA17), mRNA. |
| IFNA6 | exonic | SEQ ID 1149 | NM_021002 | HS interferon, alpha 6 (IFNA6), mRNA. |
| IFNA5 | exonic | SEQ ID 1150 | NM_002169 | HS interferon, alpha 5 (IFNA5), mRNA. |
| IFNA13 | exonic | SEQ ID 1151 | NM_006900 | HS interferon, alpha 13 (IFNA13), mRNA. |
| IFNE | exonic | SEQ ID 1152 | NM_176891 | HS interferon, epsilon (IFNE), mRNA. |
| IFNA8 | exonic | SEQ ID 1153 | NM_002170 | HS interferon, alpha 8 (IFNA8), mRNA. |
| IFNA2 | exonic | SEQ ID 1154 | NM_000605 | HS interferon, alpha 2 (IFNA2), mRNA. |
| MIR31 | exonic | SEQ ID 1155 | NR_029505 | HS microRNA 31 (MIR31), microRNA. |
| MTAP | exonic | SEQ ID 1156 | NM_002451 | HS methylthioadenosine phosphorylase (MTAP), mRNA. |
| CDKN2A | exonic | SEQ ID 1157 | NM_058195 | HS cyclin-dependent kinase inhibitor 2A (CDKN2A), tv4, mRNA. |
| CDKN2A | exonic | SEQ ID 1158 | NM_058197 | HS cyclin-dependent kinase inhibitor 2A (CDKN2A), tv3, mRNA. |
| CDKN2B | exonic | SEQ ID 1159 | NM_004936 | HS cyclin-dependent kinase inhibitor 2B (p15, inhibits CDK4) (CDKN2B), tv1, mRNA. |
| CDKN2A | exonic | SEQ ID 1160 | NM_000077 | HS cyclin-dependent kinase inhibitor 2A (CDKN2A), tv1, mRNA. |
| C9orf53 | exonic | SEQ ID 1161 | NR_024274 | HS chromosome 9 open reading frame 53 (C9orf53), non-coding RNA. |
| CDKN2B | exonic | SEQ ID 1162 | NM_078487 | HS cyclin-dependent kinase inhibitor 2B (p15, inhibits CDK4) (CDKN2B), tv2, mRNA. |
| CDKN2A | exonic | SEQ ID 1163 | NM_001195132 | HS cyclin-dependent kinase inhibitor 2A (CDKN2A), tv5, mRNA. |
| DMRTA1 | exonic | SEQ ID 1164 | NM_022160 | HS DMRT-like family A1 (DMRTA1), mRNA. |
| MAS1 | exonic | SEQ ID 1165 | NM_002377 | HS MAS1 oncogene (MAS1), mRNA. |
| MAP3K9 | exonic | SEQ ID 1166 | NM_033141 | HS mitogen-activated protein kinase kinase kinase 9 (MAP3K9), mRNA. |
| ELAVL3 | exonic | SEQ ID 1167 | NM_001420 | HS ELAV (embryonic lethal, abnormal vision, *Drosophila*)-like 3 (Hu antigen C) (ELAVL3), tv1, mRNA. |
| ELAVL3 | exonic | SEQ ID 1168 | NM_032281 | HS ELAV (embryonic lethal, abnormal vision, *Drosophila*)-like 3 (Hu antigen C) (ELAVL3), tv2, mRNA. |
| PNKD | exonic | SEQ ID 1169 | NM_015488 | HS paroxysmal nonkinesigenic dyskinesia (PNKD), nuclear gene encoding mitochondrial protein, tv1, mRNA. |
| TMBIM1 | exonic | SEQ ID 1170 | NM_022152 | HS transmembrane BAX inhibitor motif containing 1 (TMBIM1), mRNA. |
| CASC4 | exonic | SEQ ID 1171 | NM_177974 | HS cancer susceptibility candidate 4 (CASC4), tv2, mRNA. |
| CASC4 | exonic | SEQ ID 1172 | NM_138423 | HS cancer susceptibility candidate 4 (CASC4), tv1, mRNA. |
| TRAF3 | exonic | SEQ ID 1173 | NM_001199427 | HS TNF receptor-associated factor 3 (TRAF3), tv4, mRNA. |
| TRAF3 | exonic | SEQ ID 1174 | NM_003300 | HS TNF receptor-associated factor 3 (TRAF3), tv3, mRNA. |
| TRAF3 | exonic | SEQ ID 1175 | NM_145726 | HS TNF receptor-associated factor 3 (TRAF3), tv2, mRNA. |
| TRAF3 | exonic | SEQ ID 1176 | NM_145725 | HS TNF receptor-associated factor 3 (TRAF3), tv1, mRNA. |
| PCDH15 | exonic | SEQ ID 1177 | NM_033056 | HS protocadherin-related 15 (PCDH15), tvC, mRNA. |
| PCDH15 | exonic | SEQ ID 1178 | NM_001142770 | HS protocadherin-related 15 (PCDH15), tvJ, mRNA. |
| PCDH15 | exonic | SEQ ID 1179 | NM_001142773 | HS protocadherin-related 15 (PCDH15), tvH, mRNA. |
| PCDH15 | exonic | SEQ ID 1180 | NM_001142766 | HS protocadherin-related 15 (PCDH15), tvE, mRNA. |
| PCDH15 | exonic | SEQ ID 1181 | NM_001142763 | HS protocadherin-related 15 (PCDH15), tvA, mRNA. |
| PCDH15 | exonic | SEQ ID 1182 | NM_001142771 | HS protocadherin-related 15 (PCDH15), tvK, mRNA. |
| PCDH15 | exonic | SEQ ID 1183 | NM_001142767 | HS protocadherin-related 15 (PCDH15), tvF, mRNA. |
| PCDH15 | exonic | SEQ ID 1184 | NM_001142768 | HS protocadherin-related 15 (PCDH15), tvG, mRNA. |
| PCDH15 | exonic | SEQ ID 1185 | NM_001142772 | HS protocadherin-related 15 (PCDH15), tvL, mRNA. |
| PCDH15 | exonic | SEQ ID 1186 | NM_001142765 | HS protocadherin-related 15 (PCDH15), tvD, mRNA. |
| PCDH15 | exonic | SEQ ID 1187 | NM_001142769 | HS protocadherin-related 15 (PCDH15), tvI, mRNA. |
| PCDH15 | exonic | SEQ ID 1188 | NM_001142764 | HS protocadherin-related 15 (PCDH15), tvB, mRNA. |
| PEBP4 | exonic | SEQ ID 1189 | NM_144962 | HS phosphatidylethanolamine-binding protein 4 (PEBP4), mRNA. |
| SGK1 | exonic | SEQ ID 1190 | NM_001143676 | HS serum/glucocorticoid regulated kinase 1 (SGK1), tv2, mRNA. |
| NACAD | exonic | SEQ ID 1191 | NM_001146334 | HS NAC alpha domain containing (NACAD), mRNA. |
| CCM2 | exonic | SEQ ID 1192 | NR_030770 | HS cerebral cavernous malformation 2 (CCM2), tv5, non-coding RNA. |
| CCM2 | exonic | SEQ ID 1193 | NM_031443 | HS cerebral cavernous malformation 2 (CCM2), tv2, mRNA. |
| CCM2 | exonic | SEQ ID 1194 | NM_001167935 | HS cerebral cavernous malformation 2 (CCM2), tv4, mRNA. |
| CCM2 | exonic | SEQ ID 1195 | NM_001167934 | HS cerebral cavernous malformation 2 (CCM2), tv3, mRNA. |
| CCM2 | exonic | SEQ ID 1196 | NM_001029835 | HS cerebral cavernous malformation 2 (CCM2), tv1, mRNA. |
| GRAP | exonic | SEQ ID 1197 | NM_006613 | HS GRB2-related adaptor protein (GRAP), mRNA. |
| SLC5A10 | exonic | SEQ ID 1198 | NM_001270649 | HS solute carrier family 5 (sodium/glucose cotransporter), member 10 (SLC5A10), tv4, mRNA. |
| FAM83G | exonic | SEQ ID 1199 | NM_001039999 | HS family with sequence similarity 83, member G (FAM83G), mRNA. |
| SLC5A10 | exonic | SEQ ID 1200 | NM_152351 | HS solute carrier family 5 (sodium/glucose cotransporter), member 10 (SLC5A10), tv1, mRNA. |
| SLC5A10 | exonic | SEQ ID 1201 | NM_001270648 | HS solute carrier family 5 (sodium/glucose cotransporter), member 10 (SLC5A10), tv3, mRNA. |
| SLC5A10 | exonic | SEQ ID 1202 | NM_001042450 | HS solute carrier family 5 (sodium/glucose cotransporter), member 10 (SLC5A10), tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| SLC5A10 | exonic | SEQ ID 1203 | NR_073067 | HS solute carrier family 5 (sodium/glucose cotransporter), member 10 (SLC5A10), tv5, non-coding RNA. |
| BASP1P1 | exonic | SEQ ID 1204 | NR_033774 | HS brain abundant, membrane attached signal protein 1 pseudogene 1 (BASP1P1), non-coding RNA. |
| HGSNAT | exonic | SEQ ID 1205 | NM_152419 | HS heparan-alpha-glucosaminide N-acetyltransferase (HGSNAT), mRNA. |
| FNTA | exonic | SEQ ID 1206 | NR_033698 | HS farnesyltransferase, CAAX box, alpha (FNTA), tv4, non-coding RNA. |
| FNTA | exonic | SEQ ID 1207 | NM_002027 | HS farnesyltransferase, CAAX box, alpha (FNTA), tv1, mRNA. |
| SGK196 | exonic | SEQ ID 1208 | NM_032237 | HS protein kinase-like protein SgK196 (SGK196), mRNA. |
| POTEA | exonic | SEQ ID 1209 | NM_001005365 | HS POTE ankyrin domain family, member A (POTEA), tv2, mRNA. |
| POTEA | exonic | SEQ ID 1210 | NM_001002920 | HS POTE ankyrin domain family, member A (POTEA), tv1, mRNA. |
| SLCO1B3 | exonic | SEQ ID 1211 | NM_019844 | HS solute carrier organic anion transporter family, member 1B3 (SLCO1B3), mRNA. |
| HFM1 | exonic | SEQ ID 1212 | NM_001017975 | HS HFM1, ATP-dependent DNA helicase homolog (S. cerevisiae) (HFM1), mRNA. |
| DNTTIP2 | exonic | SEQ ID 1213 | NM_014597 | HS deoxynucleotidyltransferase, terminal, interacting protein 2 (DNTTIP2), mRNA. |
| CFLAR | exonic | SEQ ID 1214 | NM_001127183 | HS CASP8 and FADD-like apoptosis regulator (CFLAR), tv2, mRNA. |
| CFLAR | exonic | SEQ ID 1215 | NM_001202515 | HS CASP8 and FADD-like apoptosis regulator (CFLAR), tv4, mRNA. |
| CFLAR | exonic | SEQ ID 1216 | NM_001202519 | HS CASP8 and FADD-like apoptosis regulator (CFLAR), tv8, mRNA. |
| CFLAR | exonic | SEQ ID 1217 | NM_001202518 | HS CASP8 and FADD-like apoptosis regulator (CFLAR), tv7, mRNA. |
| CFLAR | exonic | SEQ ID 1218 | NM_001202516 | HS CASP8 and FADD-like apoptosis regulator (CFLAR), tv5, mRNA. |
| CFLAR | exonic | SEQ ID 1219 | NM_003879 | HS CASP8 and FADD-like apoptosis regulator (CFLAR), tv1, mRNA. |
| CFLAR | exonic | SEQ ID 1220 | NM_001202517 | HS CASP8 and FADD-like apoptosis regulator (CFLAR), tv6, mRNA. |
| CFLAR-AS1 | exonic | SEQ ID 1221 | NR_040030 | HS CFLAR antisense RNA 1 (CFLAR-AS1), non-coding RNA. |
| CFLAR | exonic | SEQ ID 1222 | NM_001127184 | HS CASP8 and FADD-like apoptosis regulator (CFLAR), tv3, mRNA. |
| CEP104 | exonic | SEQ ID 1223 | NM_014704 | HS centrosomal protein 104 kDa (CEP104), mRNA. |
| LOC400456 | exonic | SEQ ID 1224 | NR_034095 | HS uncharacterized LOC400456 (LOC400456), non-coding RNA. |
| CCDC171 | exonic | SEQ ID 1225 | NM_173550 | HS coiled-coil domain containing 171 (CCDC171), mRNA. |
| CTDSP1 | exonic | SEQ ID 1226 | NM_021198 | HS CTD (carboxy-terminal domain, RNA polymerase II, polypeptide A) small phosphatase 1 (CTDSP1), tv1, mRNA. |
| CTDSP1 | exonic | SEQ ID 1227 | NM_182642 | HS CTD (carboxy-terminal domain, RNA polymerase II, polypeptide A) small phosphatase 1 (CTDSP1), tv2, mRNA. |
| CTDSP1 | exonic | SEQ ID 1228 | NM_001206878 | HS CTD (carboxy-terminal domain, RNA polymerase II, polypeptide A) small phosphatase 1 (CTDSP1), tv3, mRNA. |
| SPAG16 | exonic | SEQ ID 1229 | NM_024532 | HS sperm associated antigen 16 (SPAG16), tv1, mRNA. |
| SPAG16 | exonic | SEQ ID 1230 | NR_047659 | HS sperm associated antigen 16 (SPAG16), tv3, non-coding RNA. |
| SPAG16 | exonic | SEQ ID 1231 | NR_047660 | HS sperm associated antigen 16 (SPAG16), tv4, non-coding RNA. |
| SNORD32B | exonic | SEQ ID 1232 | NR_003049 | HS small nucleolar RNA, C/D box 32B (SNORD32B), small nucleolar RNA. |
| MIR26B | exonic | SEQ ID 1233 | NR_029500 | HS microRNA 26b (MIR26B), microRNA. |
| INTS2 | exonic | SEQ ID 1234 | NM_020748 | HS integrator complex subunit 2 (INTS2), tv1, mRNA. |
| INTS2 | exonic | SEQ ID 1235 | NR_026641 | HS integrator complex subunit 2 (INTS2), tv2, non-coding RNA. |
| FUT2 | exonic | SEQ ID 1236 | NM_001097638 | HS fucosyltransferase 2 (secretor status included) (FUT2), tv2, mRNA. |
| FUT2 | exonic | SEQ ID 1237 | NM_000511 | HS fucosyltransferase 2 (secretor status included) (FUT2), tv1, mRNA. |
| PNKD | exonic | SEQ ID 1238 | NM_001077399 | HS paroxysmal nonkinesigenic dyskinesia (PNKD), nuclear gene encoding mitochondrial protein, tv3, mRNA. |
| PRSS38 | exonic | SEQ ID 1239 | NM_183062 | HS protease, serine, 38 (PRSS38), mRNA. |
| KAL1 | exonic | SEQ ID 1240 | NM_000216 | HS Kallmann syndrome 1 sequence (KAL1), mRNA. |
| SLC11A1 | exonic | SEQ ID 1241 | NM_000578 | HS solute carrier family 11 (proton-coupled divalent metal ion transporters), member 1 (SLC11A1), mRNA. |
| STX6 | exonic | SEQ ID 1242 | NM_005819 | HS syntaxin 6 (STX6), mRNA. |
| MR1 | exonic | SEQ ID 1243 | NM_001195000 | HS major histocompatibility complex, class I-related (MR1), tv3, mRNA. |
| MR1 | exonic | SEQ ID 1244 | NM_001195035 | HS major histocompatibility complex, class I-related (MR1), tv4, mRNA. |
| MR1 | exonic | SEQ ID 1245 | NM_001194999 | HS major histocompatibility complex, class I-related (MR1), tv2, mRNA. |
| MR1 | exonic | SEQ ID 1246 | NM_001531 | HS major histocompatibility complex, class I-related (MR1), tv1, mRNA. |
| OR52E4 | exonic | SEQ ID 1247 | NM_001005165 | HS olfactory receptor, family 52, subfamily E, member 4 (OR52E4), mRNA. |
| PRPSAP2 | exonic | SEQ ID 1248 | NM_001243942 | HS phosphoribosyl pyrophosphate synthetase-associated protein 2 (PRPSAP2), tv5, mRNA. |
| PRPSAP2 | exonic | SEQ ID 1249 | NM_001243941 | HS phosphoribosyl pyrophosphate synthetase-associated protein 2 (PRPSAP2), tv4, mRNA. |
| PRPSAP2 | exonic | SEQ ID 1250 | NM_002767 | HS phosphoribosyl pyrophosphate synthetase-associated protein 2 (PRPSAP2), tv1, mRNA. |
| PRPSAP2 | exonic | SEQ ID 1251 | NM_001243940 | HS phosphoribosyl pyrophosphate synthetase-associated protein 2 (PRPSAP2), tv3, mRNA. |
| PRPSAP2 | exonic | SEQ ID 1252 | NM_001243936 | HS phosphoribosyl pyrophosphate synthetase-associated protein 2 (PRPSAP2), tv2, mRNA. |
| IGF2R | exonic | SEQ ID 1253 | NM_000876 | HS insulin-like growth factor 2 receptor (IGF2R), mRNA. |
| AIRN | exonic | SEQ ID 1254 | NR_047514 | HS antisense of IGF2R non-protein coding RNA (AIRN), tv2, non-coding RNA. |
| AIRN | exonic | SEQ ID 1255 | NR_047511 | HS antisense of IGF2R non-protein coding RNA (AIRN), tv1, non-coding RNA. |
| FAM9A | exonic | SEQ ID 1256 | NM_001171186 | HS family with sequence similarity 9, member A (FAM9A), tv1, mRNA. |
| FAM9A | exonic | SEQ ID 1257 | NM_174951 | HS family with sequence similarity 9, member A (FAM9A), tv2, mRNA. |
| RNU6-59 | exonic | SEQ ID 1258 | NR_046933 | HS RNA, U6 small nuclear 59 (RNU6-59), small nuclear RNA. |
| MTRNR2L5 | exonic | SEQ ID 1259 | NM_001190478 | HS MT-RNR2-like 5 (MTRNR2L5), mRNA. |
| PACS2 | exonic | SEQ ID 1260 | NM_001243127 | HS phosphofurin acidic cluster sorting protein 2 (PACS2), tv3, mRNA. |
| PACS2 | exonic | SEQ ID 1261 | NM_015197 | HS phosphofurin acidic cluster sorting protein 2 (PACS2), tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| PACS2 | exonic | SEQ ID 1262 | NM_001100913 | HS phosphofurin acidic cluster sorting protein 2 (PACS2), tv1, mRNA. |
| RCOR1 | exonic | SEQ ID 1263 | NM_015156 | HS REST corepressor 1 (RCOR1), mRNA. |
| CDC42BPB | exonic | SEQ ID 1264 | NM_006035 | HS CDC42 binding protein kinase beta (DMPK-like) (CDC42BPB), mRNA. |
| TECPR2 | exonic | SEQ ID 1265 | NM_014863 | HS tectonin beta-propeller repeat containing 2 (TECPR2), tv1, mRNA. |
| PPP1R13B | exonic | SEQ ID 1266 | NM_015316 | HS protein phosphatase 1, regulatory subunit 13B (PPP1R13B), mRNA. |
| TDRD9 | exonic | SEQ ID 1267 | NM_153046 | HS tudor domain containing 9 (TDRD9), mRNA. |
| MARK3 | exonic | SEQ ID 1268 | NM_002376 | HS MAP/microtubule affinity-regulating kinase 3 (MARK3), tv3, mRNA. |
| MARK3 | exonic | SEQ ID 1269 | NM_001128918 | HS MAP/microtubule affinity-regulating kinase 3 (MARK3), tv1, mRNA. |
| MARK3 | exonic | SEQ ID 1270 | NM_001128921 | HS MAP/microtubule affinity-regulating kinase 3 (MARK3), tv5, mRNA. |
| MARK3 | exonic | SEQ ID 1271 | NM_001128919 | HS MAP/microtubule affinity-regulating kinase 3 (MARK3), tv2, mRNA. |
| MARK3 | exonic | SEQ ID 1272 | NM_001128920 | HS MAP/microtubule affinity-regulating kinase 3 (MARK3), tv4, mRNA. |
| KIF26A | exonic | SEQ ID 1273 | NM_015656 | HS kinesin family member 26A (KIF26A), mRNA. |
| GPR132 | exonic | SEQ ID 1274 | NM_013345 | HS G protein-coupled receptor 132 (GPR132), mRNA. |
| PLD4 | exonic | SEQ ID 1275 | NM_138790 | HS phospholipase D family, member 4 (PLD4), mRNA. |
| MTA1 | exonic | SEQ ID 1276 | NM_001203258 | HS metastasis associated 1 (MTA1), tv2, mRNA. |
| MTA1 | exonic | SEQ ID 1277 | NM_004689 | HS metastasis associated 1 (MTA1), tv1, mRNA. |
| MIR4309 | exonic | SEQ ID 1278 | NR_036162 | HS microRNA 4309 (MIR4309), microRNA. |
| ANKRD9 | exonic | SEQ ID 1279 | NM_152326 | HS ankyrin repeat domain 9 (ANKRD9), mRNA. |
| AMN | exonic | SEQ ID 1280 | NM_030943 | HS amnion associated transmembrane protein (AMN), mRNA. |
| EXOC3L4 | exonic | SEQ ID 1281 | NM_001077594 | HS exocyst complex component 3-like 4 (EXOC3L4), mRNA. |
| TNFAIP2 | exonic | SEQ ID 1282 | NM_006291 | HS tumor necrosis factor, alpha-induced protein 2 (TNFAIP2), mRNA. |
| LINC00605 | exonic | SEQ ID 1283 | NR_033938 | HS long intergenic non-protein coding RNA 605 (LINC00605), non-coding RNA. |
| EIF5 | exonic | SEQ ID 1284 | NM_183004 | HS eukaryotic translation initiation factor 5 (EIF5), tv2, mRNA. |
| SNORA28 | exonic | SEQ ID 1285 | NR_002964 | HS small nucleolar RNA, H/ACA box 28 (SNORA28), small nucleolar RNA. |
| EIF5 | exonic | SEQ ID 1286 | NM_001969 | HS eukaryotic translation initiation factor 5 (EIF5), tv1, mRNA. |
| CKB | exonic | SEQ ID 1287 | NM_001823 | HS creatine kinase, brain (CKB), mRNA. |
| APOPT1 | exonic | SEQ ID 1288 | NM_032374 | HS apoptogenic 1, mitochondrial (APOPT1), nuclear gene encoding mitochondrial protein, mRNA. |
| BAG5 | exonic | SEQ ID 1289 | NM_004873 | HS BCL2-associated athanogene 5 (BAG5), tv2, mRNA. |
| BAG5 | exonic | SEQ ID 1290 | NM_001015048 | HS BCL2-associated athanogene 5 (BAG5), tv3, mRNA. |
| BAG5 | exonic | SEQ ID 1291 | NM_001015049 | HS BCL2-associated athanogene 5 (BAG5), tv1, mRNA. |
| TRMT61A | exonic | SEQ ID 1292 | NM_152307 | HS tRNA methyltransferase 61 homolog A (S. cerevisiae) (TRMT61A), mRNA. |
| ZFYVE21 | exonic | SEQ ID 1293 | NM_024071 | HS zinc finger, FYVE domain containing 21 (ZFYVE21), tv2, mRNA. |
| XRCC3 | exonic | SEQ ID 1294 | NM_005432 | HS X-ray repair complementing defective repair in Chinese hamster cells 3 (XRCC3), tv2, mRNA. |
| KLC1 | exonic | SEQ ID 1295 | NM_005552 | HS kinesin light chain 1 (KLC1), tv1, mRNA. |
| XRCC3 | exonic | SEQ ID 1296 | NM_001100119 | HS X-ray repair complementing defective repair in Chinese hamster cells 3 (XRCC3), tv1, mRNA. |
| XRCC3 | exonic | SEQ ID 1297 | NM_001100118 | HS X-ray repair complementing defective repair in Chinese hamster cells 3 (XRCC3), tv3, mRNA. |
| ZFYVE21 | exonic | SEQ ID 1298 | NM_001198953 | HS zinc finger, FYVE domain containing 21 (ZFYVE21), tv1, mRNA. |
| KLC1 | exonic | SEQ ID 1299 | NM_001130107 | HS kinesin light chain 1 (KLC1), tv3, mRNA. |
| KLC1 | exonic | SEQ ID 1300 | NM_182923 | HS kinesin light chain 1 (KLC1), tv2, mRNA. |
| LINC00637 | exonic | SEQ ID 1301 | NR_038436 | HS long intergenic non-protein coding RNA 637 (LINC00637), non-coding RNA. |
| C14orf2 | exonic | SEQ ID 1302 | NM_004894 | HS chromosome 14 open reading frame 2 (C14orf2), tv1, mRNA. |
| RD3L | exonic | SEQ ID 1303 | NM_001257268 | HS retinal degeneration 3-like (RD3L), mRNA. |
| C14orf2 | exonic | SEQ ID 1304 | NM_001127393 | HS chromosome 14 open reading frame 2 (C14orf2), tv2, mRNA. |
| MIR203 | exonic | SEQ ID 1305 | NR_029620 | HS microRNA 203 (MIR203), microRNA. |
| ASPG | exonic | SEQ ID 1306 | NM_001080464 | HS asparaginase homolog (S. cerevisiae) (ASPG), mRNA. |
| MIR3545 | exonic | SEQ ID 1307 | NR_039859 | HS microRNA 3545 (MIR3545), microRNA. |
| TMEM179 | exonic | SEQ ID 1308 | NM_207343 | HS transmembrane protein 179 (TMEM179), mRNA. |
| C14orf180 | exonic | SEQ ID 1309 | NM_001008404 | HS chromosome 14 open reading frame 180 (C14orf180), mRNA. |
| INF2 | exonic | SEQ ID 1310 | NM_022489 | HS inverted formin, FH2 and WH2 domain containing (INF2), tv1, mRNA. |
| SIVA1 | exonic | SEQ ID 1311 | NM_006427 | HS SIVA1, apoptosis-inducing factor (SIVA1), tv1, mRNA. |
| ADSSL1 | exonic | SEQ ID 1312 | NM_199165 | HS adenylosuccinate synthase like 1 (ADSSL1), tv1, mRNA. |
| AKT1 | exonic | SEQ ID 1313 | NM_005163 | HS v-akt murine thymoma viral oncogene homolog 1 (AKT1), tv1, mRNA. |
| SIVA1 | exonic | SEQ ID 1314 | NM_021709 | HS SIVA1, apoptosis-inducing factor (SIVA1), tv2, mRNA. |
| ADSSL1 | exonic | SEQ ID 1315 | NM_152328 | HS adenylosuccinate synthase like 1 (ADSSL1), tv2, mRNA. |
| AKT1 | exonic | SEQ ID 1316 | NM_001014432 | HS v-akt murine thymoma viral oncogene homolog 1 (AKT1), tv2, mRNA. |
| AKT1 | exonic | SEQ ID 1317 | NM_001014431 | HS v-akt murine thymoma viral oncogene homolog 1 (AKT1), tv3, mRNA. |
| INF2 | exonic | SEQ ID 1318 | NM_001031714 | HS inverted formin, FH2 and WH2 domain containing (INF2), tv2, mRNA. |
| MIR4710 | exonic | SEQ ID 1319 | NR_039860 | HS microRNA 4710 (MIR4710), microRNA. |
| INF2 | exonic | SEQ ID 1320 | NM_032714 | HS inverted formin, FH2 and WH2 domain containing (INF2), tv3, mRNA. |
| CEP170B/KIAA0284 | exonic | SEQ ID 1321 | NM_001112726 | HS centrosomal protein 170B (CEP170B), tv1, mRNA. |
| LINC00638 | exonic | SEQ ID 1322 | NR_024396 | HS long intergenic non-protein coding RNA 638 (LINC00638), non-coding RNA. |
| ZBTB42 | exonic | SEQ ID 1323 | NM_001137601 | HS zinc finger and BTB domain containing 42 (ZBTB42), mRNA. |
| CEP170B/KIAA0284 | exonic | SEQ ID 1324 | NM_015005 | HS centrosomal protein 170B (CEP170B), tv2, mRNA. |
| CDCA4 | exonic | SEQ ID 1325 | NM_145701 | HS cell division cycle associated 4 (CDCA4), tv2, mRNA. |
| C14orf79 | exonic | SEQ ID 1326 | NM_174891 | HS chromosome 14 open reading frame 79 (C14orf79), mRNA. |
| CDCA4 | exonic | SEQ ID 1327 | NM_017955 | HS cell division cycle associated 4 (CDCA4), tv1, mRNA. |
| AHNAK2 | exonic | SEQ ID 1328 | NM_138420 | HS AHNAK nucleoprotein 2 (AHNAK2), mRNA. |
| JAG2 | exonic | SEQ ID 1329 | NM_002226 | HS jagged 2 (JAG2), tv1, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| NUDT14 | exonic | SEQ ID 1330 | NM_177533 | HS nudix (nucleoside diphosphate linked moiety X)-type motif 14 (NUDT14), mRNA. |
| JAG2 | exonic | SEQ ID 1331 | NM_145159 | HS jagged 2 (JAG2), tv2, mRNA. |
| BRF1 | exonic | SEQ ID 1332 | NM_145685 | HS BRF1 homolog, subunit of RNA polymerase III transcription initiation factor IIIB (S. cerevisiae) (BRF1), tv3, mRNA. |
| BRF1 | exonic | SEQ ID 1333 | NM_001242787 | HS BRF1 homolog, subunit of RNA polymerase III transcription initiation factor IIIB (S. cerevisiae) (BRF1), tv5, mRNA. |
| BRF1 | exonic | SEQ ID 1334 | NM_001242786 | HS BRF1 homolog, subunit of RNA polymerase III transcription initiation factor IIIB (S. cerevisiae) (BRF1), tv4, mRNA. |
| BRF1 | exonic | SEQ ID 1335 | NM_001242790 | HS BRF1 homolog, subunit of RNA polymerase III transcription initiation factor IIIB (S. cerevisiae) (BRF1), tv8, mRNA. |
| BRF1 | exonic | SEQ ID 1336 | NM_001242789 | HS BRF1 homolog, subunit of RNA polymerase III transcription initiation factor IIIB (S. cerevisiae) (BRF1), tv7, mRNA. |
| BRF1 | exonic | SEQ ID 1337 | NM_001242788 | HS BRF1 homolog, subunit of RNA polymerase III transcription initiation factor IIIB (S. cerevisiae) (BRF1), tv6, mRNA. |
| BRF1 | exonic | SEQ ID 1338 | NM_001519 | HS BRF1 homolog, subunit of RNA polymerase III transcription initiation factor IIIB (S. cerevisiae) (BRF1), tv1, mRNA. |
| BTBD6 | exonic | SEQ ID 1339 | NM_033271 | HS BTB (POZ) domain containing 6 (BTBD6), mRNA. |
| TEX22 | exonic | SEQ ID 1340 | NM_001195082 | HS testis expressed 22 (TEX22), mRNA. |
| CRIP2 | exonic | SEQ ID 1341 | NM_001312 | HS cysteine-rich protein 2 (CRIP2), tv1, mRNA. |
| C14orf80 | exonic | SEQ ID 1342 | NM_001198983 | HS chromosome 14 open reading frame 80 (C14orf80), tv5, mRNA. |
| C14orf80 | exonic | SEQ ID 1343 | NM_001134875 | HS chromosome 14 open reading frame 80 (C14orf80), tv1, mRNA. |
| CRIP1 | exonic | SEQ ID 1344 | NM_001311 | HS cysteine-rich protein 1 (intestinal) (CRIP1), mRNA. |
| C14orf80 | exonic | SEQ ID 1345 | NM_001134877 | HS chromosome 14 open reading frame 80 (C14orf80), tv4, mRNA. |
| C14orf80 | exonic | SEQ ID 1346 | NM_001134876 | HS chromosome 14 open reading frame 80 (C14orf80), tv2, mRNA. |
| TMEM121 | exonic | SEQ ID 1347 | NM_025268 | HS transmembrane protein 121 (TMEM121), mRNA. |
| CRIP2 | exonic | SEQ ID 1348 | NM_001270841 | HS cysteine-rich protein 2 (CRIP2), tv3, mRNA. |
| CRIP2 | exonic | SEQ ID 1349 | NM_001270837 | HS cysteine-rich protein 2 (CRIP2), tv2, mRNA. |
| CRIP2 | exonic | SEQ ID 1350 | NR_073082 | HS cysteine-rich protein 2 (CRIP2), tv5, non-coding RNA. |
| CRIP2 | exonic | SEQ ID 1351 | NR_073081 | HS cysteine-rich protein 2 (CRIP2), tv4, non-coding RNA. |
| CRIP2 | exonic | SEQ ID 1352 | NR_073083 | HS cysteine-rich protein 2 (CRIP2), tv6, non-coding RNA. |
| CRIP2 | exonic | SEQ ID 1353 | NR_073084 | HS cysteine-rich protein 2 (CRIP2), tv7, non-coding RNA. |
| CRIP2 | exonic | SEQ ID 1354 | NR_073085 | HS cysteine-rich protein 2 (CRIP2), tv8, non-coding RNA. |
| ELK2AP | exonic | SEQ ID 1355 | NR_046211 | HS ELK2A, member of ETS oncogene family, pseudogene (ELK2AP), non-coding RNA. |
| TPO | exonic | SEQ ID 1356 | NM_175722 | HS thyroid peroxidase (TPO), tv5, mRNA. |
| TPO | exonic | SEQ ID 1357 | NM_175721 | HS thyroid peroxidase (TPO), tv4, mRNA. |
| TPO | exonic | SEQ ID 1358 | NM_000547 | HS thyroid peroxidase (TPO), tv1, mRNA. |
| TPO | exonic | SEQ ID 1359 | NM_175719 | HS thyroid peroxidase (TPO), tv2, mRNA. |
| TPO | exonic | SEQ ID 1360 | NM_001206744 | HS thyroid peroxidase (TPO), tv6, mRNA. |
| TPO | exonic | SEQ ID 1361 | NM_001206745 | HS thyroid peroxidase (TPO), tv7, mRNA. |
| SLC7A3 | exonic | SEQ ID 1362 | NM_001048164 | HS solute carrier family 7 (cationic amino acid transporter, y+ system), member 3 (SLC7A3), tv2, mRNA. |
| SLC7A3 | exonic | SEQ ID 1363 | NM_032803 | HS solute carrier family 7 (cationic amino acid transporter, y+ system), member 3 (SLC7A3), tv1, mRNA. |
| BRD7 | exonic | SEQ ID 1364 | NM_001173984 | HS bromodomain containing 7 (BRD7), tv1, mRNA. |
| BRD7 | exonic | SEQ ID 1365 | NM_013263 | HS bromodomain containing 7 (BRD7), tv2, mRNA. |
| ZIM3 | exonic | SEQ ID 1366 | NM_052882 | HS zinc finger, imprinted 3 (ZIM3), mRNA. |
| RGN | exonic | SEQ ID 1367 | NM_152869 | HS regucalcin (senescence marker protein-30) (RGN), tv2, mRNA. |
| RGN | exonic | SEQ ID 1368 | NM_004683 | HS regucalcin (senescence marker protein-30) (RGN), tv1, mRNA. |
| ZDHHC9 | exonic | SEQ ID 1369 | NM_016032 | HS zinc finger, DHHC-type containing 9 (ZDHHC9), tv1, mRNA. |
| ZDHHC9 | exonic | SEQ ID 1370 | NM_001008222 | HS zinc finger, DHHC-type containing 9 (ZDHHC9), tv2, mRNA. |
| TENM1 | exonic | SEQ ID 1371 | NM_001163279 | HS teneurin transmembrane protein 1 (TENM1), tv2, mRNA. |
| TENM1 | exonic | SEQ ID 1372 | NM_001163278 | HS teneurin transmembrane protein 1 (TENM1), tv1, mRNA. |
| TENM1 | exonic | SEQ ID 1373 | NM_014253 | HS teneurin transmembrane protein 1 (TENM1), tv3, mRNA. |
| ARMCX4 | exonic | SEQ ID 1374 | NR_045862 | HS armadillo repeat containing, X-linked 4 (ARMCX4), tv5, non-coding RNA. |
| ARMCX4 | exonic | SEQ ID 1375 | NR_045864 | HS armadillo repeat containing, X-linked 4 (ARMCX4), tv3, non-coding RNA. |
| ARMCX4 | exonic | SEQ ID 1376 | NR_045861 | HS armadillo repeat containing, X-linked 4 (ARMCX4), tv4, non-coding RNA. |
| ARMCX4 | exonic | SEQ ID 1377 | NR_028407 | HS armadillo repeat containing, X-linked 4 (ARMCX4), tv2, non-coding RNA. |
| GRIN2D | exonic | SEQ ID 1378 | NM_000836 | HS glutamate receptor, ionotropic, N-methyl D-aspartate 2D (GRIN2D), mRNA. |
| KDELR1 | exonic | SEQ ID 1379 | NM_006801 | HS KDEL (Lys-Asp-Glu-Leu) endoplasmic reticulum protein retention receptor 1 (KDELR1), mRNA. |
| ARMCX4 | exonic | SEQ ID 1380 | NR_045863 | HS armadillo repeat containing, X-linked 4 (ARMCX4), tv6, non-coding RNA. |
| RPSAP58 | exonic | SEQ ID 1381 | NR_003662 | HS ribosomal protein SA pseudogene 58 (RPSAP58), non-coding RNA. |
| MICAL3 | exonic | SEQ ID 1382 | NM_015241 | HS microtubule associated monoxygenase, calponin and LIM domain containing 3 (MICAL3), tv1, mRNA. |
| TMEM231 | exonic | SEQ ID 1383 | NM_001077419 | HS transmembrane protein 231 (TMEM231), tv3, mRNA. |
| CHST5 | exonic | SEQ ID 1384 | NM_024533 | HS carbohydrate (N-acetylglucosamine 6-O) sulfotransferase 5 (CHST5), mRNA. |
| TMEM231 | exonic | SEQ ID 1385 | NM_001077416 | HS transmembrane protein 231 (TMEM231), tv1, mRNA. |
| TMEM231 | exonic | SEQ ID 1386 | NM_001077418 | HS transmembrane protein 231 (TMEM231), tv2, mRNA. |
| ZNF835 | exonic | SEQ ID 1387 | NM_001005850 | HS zinc finger protein 835 (ZNF835), mRNA. |
| ZIM2 | exonic | SEQ ID 1388 | NM_015363 | HS zinc finger, imprinted 2 (ZIM2), tv1, mRNA. |
| ZIM2 | exonic | SEQ ID 1389 | NM_001146327 | HS zinc finger, imprinted 2 (ZIM2), tv3, mRNA. |
| ZIM2 | exonic | SEQ ID 1390 | NM_001146326 | HS zinc finger, imprinted 2 (ZIM2), tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| SMIM17/LOC147670 | exonic | SEQ ID 1391 | NM_001193628 | HS small integral membrane protein 17 (SMIM17), mRNA. |
| ZNF71 | exonic | SEQ ID 1392 | NM_021216 | HS zinc finger protein 71 (ZNF71), mRNA. |
| MIMT1 | exonic | SEQ ID 1393 | NR_024059 | HS MER1 repeat containing imprinted transcript 1 (non-protein coding) (MIMT1), non-coding RNA. |
| PEG3-AS1 | exonic | SEQ ID 1394 | NR_023847 | HS PEG3 antisense RNA 1 (PEG3-AS1), antisense RNA. |
| PEG3 | exonic | SEQ ID 1395 | NM_001146186 | HS paternally expressed 3 (PEG3), tv4, mRNA. |
| PEG3 | exonic | SEQ ID 1396 | NM_001146184 | HS paternally expressed 3 (PEG3), tv2, mRNA. |
| PEG3 | exonic | SEQ ID 1397 | NM_001146185 | HS paternally expressed 3 (PEG3), tv3, mRNA. |
| PEG3 | exonic | SEQ ID 1398 | NM_006210 | HS paternally expressed 3 (PEG3), tv1, mRNA. |
| PEG3 | exonic | SEQ ID 1399 | NM_001146187 | HS paternally expressed 3 (PEG3), tv5, mRNA. |
| USP29 | exonic | SEQ ID 1400 | NM_020903 | HS ubiquitin specific peptidase 29 (USP29), mRNA. |
| DUXA | exonic | SEQ ID 1401 | NM_001012729 | HS double homeobox A (DUXA), mRNA. |
| ZNF805 | exonic | SEQ ID 1402 | NM_001145078 | HS zinc finger protein 805 (ZNF805), tv2, mRNA. |
| ZNF805 | exonic | SEQ ID 1403 | NM_001023563 | HS zinc finger protein 805 (ZNF805), tv1, mRNA. |
| AURKC | exonic | SEQ ID 1404 | NM_003160 | HS aurora kinase C (AURKC), tv3, mRNA. |
| ZNF264 | exonic | SEQ ID 1405 | NM_003417 | HS zinc finger protein 264 (ZNF264), mRNA. |
| ZNF460 | exonic | SEQ ID 1406 | NM_006635 | HS zinc finger protein 460 (ZNF460), mRNA. |
| AURKC | exonic | SEQ ID 1407 | NM_001015878 | HS aurora kinase C (AURKC), tv1, mRNA. |
| AURKC | exonic | SEQ ID 1408 | NM_001015879 | HS aurora kinase C (AURKC), tv2, mRNA. |
| ZNF17 | exonic | SEQ ID 1409 | NM_006959 | HS zinc finger protein 17 (ZNF17), mRNA. |
| ZNF749 | exonic | SEQ ID 1410 | NM_001023561 | HS zinc finger protein 749 (ZNF749), mRNA. |
| ZNF543 | exonic | SEQ ID 1411 | NM_213598 | HS zinc finger protein 543 (ZNF543), mRNA. |
| ZNF547 | exonic | SEQ ID 1412 | NM_173631 | HS zinc finger protein 547 (ZNF547), mRNA. |
| ZNF548 | exonic | SEQ ID 1413 | NM_152909 | HS zinc finger protein 548 (ZNF548), tv2, mRNA. |
| ZNF304 | exonic | SEQ ID 1414 | NM_020657 | HS zinc finger protein 304 (ZNF304), mRNA. |
| ZNF548 | exonic | SEQ ID 1415 | NM_001172773 | HS zinc finger protein 548 (ZNF548), tv1, mRNA. |
| TRAPPC2P1 | exonic | SEQ ID 1416 | NR_002166 | HS trafficking protein particle complex 2 pseudogene 1 (TRAPPC2P1), non-coding RNA. |
| VN1R1 | exonic | SEQ ID 1417 | NM_020633 | HS vomeronasal 1 receptor 1 (VN1R1), mRNA. |
| CTSL2 | exonic | SEQ ID 1418 | NM_001201575 | HS cathepsin L2 (CTSL2), tv2, mRNA. |
| CTSL2 | exonic | SEQ ID 1419 | NM_001333 | HS cathepsin L2 (CTSL2), tv1, mRNA. |
| TLR8 | exonic | SEQ ID 1420 | NM_138636 | HS toll-like receptor 8 (TLR8), mRNA. |
| TLR8-AS1 | exonic | SEQ ID 1421 | NR_030727 | HS TLR8 antisense RNA 1 (TLR8-AS1), non-coding RNA. |
| EPHA8 | exonic | SEQ ID 1422 | NM_020526 | HS EPH receptor A8 (EPHA8), tv1, mRNA. |
| EPHA8 | exonic | SEQ ID 1423 | NM_001006943 | HS EPH receptor A8 (EPHA8), tv2, mRNA. |
| UST | exonic | SEQ ID 1424 | NM_005715 | HS uronyl-2-sulfotransferase (UST), mRNA. |
| CORIN | exonic | SEQ ID 1425 | NM_006587 | HS corin, serine peptidase (CORIN), mRNA. |
| TGFBR3 | exonic | SEQ ID 1426 | NM_001195684 | HS transforming growth factor, beta receptor III (TGFBR3), tv3, mRNA. |
| TGFBR3 | exonic | SEQ ID 1427 | NM_001195683 | HS transforming growth factor, beta receptor III (TGFBR3), tv2, mRNA. |
| TGFBR3 | exonic | SEQ ID 1428 | NM_003243 | HS transforming growth factor, beta receptor III (TGFBR3), tv1, mRNA. |
| TGFBR3 | exonic | SEQ ID 1429 | NR_036634 | HS transforming growth factor, beta receptor III (TGFBR3), tv4, non-coding RNA. |
| EPSTI1 | exonic | SEQ ID 1430 | NM_033255 | HS epithelial stromal interaction 1 (breast) (EPSTI1), tv2, mRNA. |
| EPSTI1 | exonic | SEQ ID 1431 | NM_001002264 | HS epithelial stromal interaction 1 (breast) (EPSTI1), tv1, mRNA. |
| RAB32 | exonic | SEQ ID 1432 | NM_006834 | HS RAB32, member RAS oncogene family (RAB32), mRNA. |
| CPNE9 | exonic | SEQ ID 1433 | NM_153635 | HS copine family member IX (CPNE9), mRNA. |
| C14orf166 | exonic | SEQ ID 1434 | NM_016039 | HS chromosome 14 open reading frame 166 (C14orf166), mRNA. |
| ALDH1A3 | exonic | SEQ ID 1435 | NM_000693 | HS aldehyde dehydrogenase 1 family, member A3 (ALDH1A3), mRNA. |
| KIF7 | exonic | SEQ ID 1436 | NM_198525 | HS kinesin family member 7 (KIF7), mRNA. |
| GPR98 | exonic | SEQ ID 1437 | NR_003149 | HS G protein-coupled receptor 98 (GPR98), tv2, non-coding RNA. |
| GPR98 | exonic | SEQ ID 1438 | NM_032119 | HS G protein-coupled receptor 98 (GPR98), tv1, mRNA. |
| UXS1 | exonic | SEQ ID 1439 | NM_025076 | HS UDP-glucuronate decarboxylase 1 (UXS1), tv2, mRNA. |
| UXS1 | exonic | SEQ ID 1440 | NR_045607 | HS UDP-glucuronate decarboxylase 1 (UXS1), tv4, non-coding RNA. |
| UXS1 | exonic | SEQ ID 1441 | NM_001253875 | HS UDP-glucuronate decarboxylase 1 (UXS1), tv1, mRNA. |
| PDCD6IP | exonic | SEQ ID 1442 | NM_013374 | HS programmed cell death 6 interacting protein (PDCD6IP), tv1, mRNA. |
| PDCD6IP | exonic | SEQ ID 1443 | NM_001162429 | HS programmed cell death 6 interacting protein (PDCD6IP), tv2, mRNA. |
| DYNC2LI1 | exonic | SEQ ID 1444 | NM_015522 | HS dynein, cytoplasmic 2, light intermediate chain 1 (DYNC2LI1), tv2, mRNA. |
| DYNC2LI1 | exonic | SEQ ID 1445 | NM_016008 | HS dynein, cytoplasmic 2, light intermediate chain 1 (DYNC2LI1), tv1, mRNA. |
| DYNC2LI1 | exonic | SEQ ID 1446 | NM_001193464 | HS dynein, cytoplasmic 2, light intermediate chain 1 (DYNC2LI1), tv4, mRNA. |
| CTNNA3 | exonic | SEQ ID 1447 | NM_013266 | HS catenin (cadherin-associated protein), alpha 3 (CTNNA3), tv1, mRNA. |
| CTNNA3 | exonic | SEQ ID 1448 | NM_001127384 | HS catenin (cadherin-associated protein), alpha 3 (CTNNA3), tv2, mRNA. |
| LOC100289187 | exonic | SEQ ID 1449 | NM_001195542 | HS transmembrane protein 225-like (LOC100289187), tv2, mRNA. |
| LOC100289187 | exonic | SEQ ID 1450 | NM_001195541 | HS transmembrane protein 225-like (LOC100289187), tv1, mRNA. |
| LOC100289187 | exonic | SEQ ID 1451 | NM_001195543 | HS transmembrane protein 225-like (LOC100289187), tv3, mRNA. |
| LRRC33 | exonic | SEQ ID 1452 | NM_198565 | HS leucine rich repeat containing 33 (LRRC33), mRNA. |
| TFRC | exonic | SEQ ID 1453 | NM_003234 | HS transferrin receptor (p90, CD71) (TFRC), tv1, mRNA. |
| TFRC | exonic | SEQ ID 1454 | NM_001128148 | HS transferrin receptor (p90, CD71) (TFRC), tv2, mRNA. |
| C9orf85 | exonic | SEQ ID 1455 | NM_182505 | HS chromosome 9 open reading frame 85 (C9orf85), mRNA. |
| FA2H | exonic | SEQ ID 1456 | NM_024306 | HS fatty acid 2-hydroxylase (FA2H), mRNA. |
| DNASE1L3 | exonic | SEQ ID 1457 | NM_004944 | HS deoxyribonuclease I-like 3 (DNASE1L3), tv1, mRNA. |
| DNASE1L3 | exonic | SEQ ID 1458 | NM_001256560 | HS deoxyribonuclease I-like 3 (DNASE1L3), tv2, mRNA. |
| VWA3A | exonic | SEQ ID 1459 | NM_173615 | HS von Willebrand factor A domain containing 3A (VWA3A), mRNA. |
| IL32 | exonic | SEQ ID 1460 | NM_001012635 | HS interleukin 32 (IL32), tv6, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| IL32 | exonic | SEQ ID 1461 | NM_004221 | HS interleukin 32 (IL32), tv2, mRNA. |
| IL32 | exonic | SEQ ID 1462 | NM_001012636 | HS interleukin 32 (IL32), tv7, mRNA. |
| MMP25 | exonic | SEQ ID 1463 | NM_022468 | HS matrix metallopeptidase 25 (MMP25), mRNA. |
| IL32 | exonic | SEQ ID 1464 | NM_001012633 | HS interleukin 32 (IL32), tv4, mRNA. |
| IL32 | exonic | SEQ ID 1465 | NM_001012632 | HS interleukin 32 (IL32), tv3, mRNA. |
| IL32 | exonic | SEQ ID 1466 | NM_001012631 | HS interleukin 32 (IL32), tv1, mRNA. |
| IL32 | exonic | SEQ ID 1467 | NM_001012634 | HS interleukin 32 (IL32), tv5, mRNA. |
| IL32 | exonic | SEQ ID 1468 | NM_001012718 | HS interleukin 32 (IL32), tv8, mRNA. |
| ZNF37BP | exonic | SEQ ID 1469 | NR_026777 | HS zinc finger protein 37B, pseudogene (ZNF37BP), non-coding RNA. |
| TEKT1 | exonic | SEQ ID 1470 | NM_053285 | HS tektin 1 (TEKT1), mRNA. |
| ORM1 | exonic | SEQ ID 1471 | NM_000607 | HS orosomucoid 1 (ORM1), mRNA. |
| AKNA | exonic | SEQ ID 1472 | NM_030767 | HS AT-hook transcription factor (AKNA), mRNA. |
| ORM2 | exonic | SEQ ID 1473 | NM_000608 | HS orosomucoid 2 (ORM2), mRNA. |
| KIAA1432 | exonic | SEQ ID 1474 | NM_001206557 | HS KIAA1432 (KIAA1432), tv3, mRNA. |
| KIAA1432 | exonic | SEQ ID 1475 | NM_001135920 | HS KIAA1432 (KIAA1432), tv2, mRNA. |
| KIAA1432 | exonic | SEQ ID 1476 | NM_020829 | HS KIAA1432 (KIAA1432), tv1, mRNA. |
| COL7A1 | exonic | SEQ ID 1477 | NM_000094 | HS collagen, type VII, alpha 1 (COL7A1), mRNA. |
| MIR711 | exonic | SEQ ID 1478 | NR_031756 | HS microRNA 711 (MIR711), microRNA. |
| VPS13A | exonic | SEQ ID 1479 | NM_015186 | HS vacuolar protein sorting 13 homolog A (*S. cerevisiae*) (VPS13A), tvB, mRNA. |
| VPS13A | exonic | SEQ ID 1480 | NM_001018038 | HS vacuolar protein sorting 13 homolog A (*S. cerevisiae*) (VPS13A), tvD, mRNA. |
| VPS13A | exonic | SEQ ID 1481 | NM_033305 | HS vacuolar protein sorting 13 homolog A (*S. cerevisiae*) (VPS13A), tvA, mRNA. |
| VPS13A | exonic | SEQ ID 1482 | NM_001018037 | HS vacuolar protein sorting 13 homolog A (*S. cerevisiae*) (VPS13A), tvC, mRNA. |
| COL27A1 | exonic | SEQ ID 1483 | NM_032888 | HS collagen, type XXVII, alpha 1 (COL27A1), mRNA. |
| UQCRC1 | exonic | SEQ ID 1484 | NM_003365 | HS ubiquinol-cytochrome c reductase core protein I (UQCRC1), nuclear gene encoding mitochondrial protein, mRNA. |
| UCN2 | exonic | SEQ ID 1485 | NM_033199 | HS urocortin 2 (UCN2), mRNA. |
| MIR4793 | exonic | SEQ ID 1486 | NR_039956 | HS microRNA 4793 (MIR4793), microRNA. |
| SLC26A6 | exonic | SEQ ID 1487 | NM_134426 | HS solute carrier family 26, member 6 (SLC26A6), tv3, mRNA. |
| CELSR3 | exonic | SEQ ID 1488 | NM_001407 | HS cadherin, EGF LAG seven-pass G-type receptor 3 (flamingo homolog, *Drosophila*) (CELSR3), mRNA. |
| SLC26A6 | exonic | SEQ ID 1489 | NM_001040454 | HS solute carrier family 26, member 6 (SLC26A6), tv4, mRNA. |
| TMEM89 | exonic | SEQ ID 1490 | NM_001008269 | HS transmembrane protein 89 (TMEM89), mRNA. |
| SLC26A6 | exonic | SEQ ID 1491 | NM_134263 | HS solute carrier family 26, member 6 (SLC26A6), tv2, mRNA. |
| SLC26A6 | exonic | SEQ ID 1492 | NM_022911 | HS solute carrier family 26, member 6 (SLC26A6), tv1, mRNA. |
| TICRR | exonic | SEQ ID 1493 | NM_152259 | HS TOPBP1-interacting checkpoint and replication regulator (TICRR), mRNA. |
| ALOX12P2 | exonic | SEQ ID 1494 | NR_002710 | HS arachidonate 12-lipoxygenase pseudogene 2 (ALOX12P2), non-coding RNA. |
| FRG1 | exonic | SEQ ID 1495 | NM_004477 | HS FSHD region gene 1 (FRG1), mRNA. |
| LOC283788 | exonic | SEQ ID 1496 | NR_027436 | HS FSHD region gene 1 pseudogene (LOC283788), non-coding RNA. |
| LOC401109 | exonic | SEQ ID 1497 | NR_034088 | HS uncharacterized LOC401109 (LOC401109), non-coding RNA. |
| ZDHHC19 | exonic | SEQ ID 1498 | NM_001039617 | HS zinc finger, DHHC-type containing 19 (ZDHHC19), mRNA. |
| XAF1 | exonic | SEQ ID 1499 | NM_199139 | HS XIAP associated factor 1 (XAF1), tv2, mRNA. |
| FBXO39 | exonic | SEQ ID 1500 | NM_153230 | HS F-box protein 39 (FBXO39), mRNA. |
| XAF1 | exonic | SEQ ID 1501 | NM_017523 | HS XIAP associated factor 1 (XAF1), tv1, mRNA. |
| XAF1 | exonic | SEQ ID 1502 | NR_046397 | HS XIAP associated factor 1 (XAF1), tv4, non-coding RNA. |
| XAF1 | exonic | SEQ ID 1503 | NR_046396 | HS XIAP associated factor 1 (XAF1), tv3, non-coding RNA. |
| XAF1 | exonic | SEQ ID 1504 | NR_046398 | HS XIAP associated factor 1 (XAF1), tv5, non-coding RNA. |
| ENOX1 | exonic | SEQ ID 1505 | NM_001127615 | HS ecto-NOX disulfide-thiol exchanger 1 (ENOX1), tv2, mRNA. |
| ENOX1 | exonic | SEQ ID 1506 | NM_017993 | HS ecto-NOX disulfide-thiol exchanger 1 (ENOX1), tv1, mRNA. |
| ENOX1 | exonic | SEQ ID 1507 | NM_001242863 | HS ecto-NOX disulfide-thiol exchanger 1 (ENOX1), tv3, mRNA. |
| DNAJC15 | exonic | SEQ ID 1508 | NM_013238 | HS DnaJ (Hsp40) homolog, subfamily C, member 15 (DNAJC15), mRNA. |
| PDZK1 | exonic | SEQ ID 1509 | NM_001201325 | HS PDZ domain containing 1 (PDZK1), tv2, mRNA. |
| PDZK1 | exonic | SEQ ID 1510 | NM_002614 | HS PDZ domain containing 1 (PDZK1), tv1, mRNA. |
| PDZK1 | exonic | SEQ ID 1511 | NM_001201326 | HS PDZ domain containing 1 (PDZK1), tv3, mRNA. |
| POLR3GL | exonic | SEQ ID 1512 | NM_032305 | HS polymerase (RNA) III (DNA directed) polypeptide G (32 kD)-like (POLR3GL), mRNA. |
| POLR3C | exonic | SEQ ID 1513 | NM_006468 | HS polymerase (RNA) III (DNA directed) polypeptide C (62 kD) (POLR3C), mRNA. |
| TXNIP | exonic | SEQ ID 1514 | NM_006472 | HS thioredoxin interacting protein (TXNIP), mRNA. |
| HFE2 | exonic | SEQ ID 1515 | NM_213653 | HS hemochromatosis type 2 (juvenile) (HFE2), tva, mRNA. |
| HFE2 | exonic | SEQ ID 1516 | NM_213652 | HS hemochromatosis type 2 (juvenile) (HFE2), tvd, mRNA. |
| HFE2 | exonic | SEQ ID 1517 | NM_202004 | HS hemochromatosis type 2 (juvenile) (HFE2), tvc, mRNA. |
| HFE2 | exonic | SEQ ID 1518 | NM_145277 | HS hemochromatosis type 2 (juvenile) (HFE2), tvb, mRNA. |
| RBM8A | exonic | SEQ ID 1519 | NM_005105 | HS RNA binding motif protein 8A (RBM8A), mRNA. |
| PIAS3 | exonic | SEQ ID 1520 | NM_006099 | HS protein inhibitor of activated STAT, 3 (PIAS3), mRNA. |
| ANKRD35 | exonic | SEQ ID 1521 | NM_144698 | HS ankyrin repeat domain 35 (ANKRD35), mRNA. |
| PEX11B | exonic | SEQ ID 1522 | NM_003846 | HS peroxisomal biogenesis factor 11 beta (PEX11B), tv1, mRNA. |
| GNRHR2 | exonic | SEQ ID 1523 | NR_002328 | HS gonadotropin-releasing hormone (type 2) receptor 2 (GNRHR2), non-coding RNA. |
| PEX11B | exonic | SEQ ID 1524 | NM_001184795 | HS peroxisomal biogenesis factor 11 beta (PEX11B), tv2, mRNA. |
| ANKRD34A | exonic | SEQ ID 1525 | NM_001039888 | HS ankyrin repeat domain 34A (ANKRD34A), mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| NUDT17 | exonic | SEQ ID 1526 | NM_001012758 | HS nudix (nucleoside diphosphate linked moiety X)-type motif 17 (NUDT17), mRNA. |
| LIX1L | exonic | SEQ ID 1527 | NM_153713 | HS Lix1 homolog (mouse)-like (LIX1L), mRNA. |
| ITGA10 | exonic | SEQ ID 1528 | NM_003637 | HS integrin, alpha 10 (ITGA10), mRNA. |
| CD160 | exonic | SEQ ID 1529 | NM_007053 | HS CD160 molecule (CD160), mRNA. |
| RNF115 | exonic | SEQ ID 1530 | NM_014455 | HS ring finger protein 115 (RNF115), mRNA. |
| TCTEX1D2 | exonic | SEQ ID 1531 | NM_152773 | HS Tctex1 domain containing 2 (TCTEX1D2), mRNA. |
| SDHAP1 | exonic | SEQ ID 1532 | NR_003264 | HS succinate dehydrogenase complex, subunit A, flavoprotein pseudogene 1 (SDHAP1), non-coding RNA. |
| PCYT1A | exonic | SEQ ID 1533 | NM_005017 | HS phosphate cytidylyltransferase 1, choline, alpha (PCYT1A), mRNA. |
| SLC51A | exonic | SEQ ID 1534 | NM_152672 | HS solute carrier family 51, alpha subunit (SLC51A), mRNA. |
| TM4SF19-TCTEX1D2 | exonic | SEQ ID 1535 | NR_037950 | HS TM4SF19-TCTEX1D2 readthrough (TM4SF19-TCTEX1D2), non-coding RNA. |
| GPR89A | exonic | SEQ ID 1536 | NM_001097613 | HS G protein-coupled receptor 89A (GPR89A), tv2, mRNA. |
| GPR89A | exonic | SEQ ID 1537 | NM_001097612 | HS G protein-coupled receptor 89A (GPR89A), tv1, mRNA. |
| GPR89A | exonic | SEQ ID 1538 | NR_036541 | HS G protein-coupled receptor 89A (GPR89A), tv3, non-coding RNA. |
| UQCRC2 | exonic | SEQ ID 1539 | NM_003366 | HS ubiquinol-cytochrome c reductase core protein II (UQCRC2), nuclear gene encoding mitochondrial protein, mRNA. |
| EEF2K | exonic | SEQ ID 1540 | NM_013302 | HS eukaryotic elongation factor-2 kinase (EEF2K), mRNA. |
| CDR2 | exonic | SEQ ID 1541 | NM_001802 | HS cerebellar degeneration-related protein 2, 62 kDa (CDR2), mRNA. |
| PDZD9 | exonic | SEQ ID 1542 | NM_173806 | HS PDZ domain containing 9 (PDZD9), tv1, mRNA. |
| PDZD9 | exonic | SEQ ID 1543 | NR_033694 | HS PDZ domain containing 9 (PDZD9), tv2, non-coding RNA. |
| C16orf52 | exonic | SEQ ID 1544 | NM_001164579 | HS chromosome 16 open reading frame 52 (C16orf52), mRNA. |
| POLR3E | exonic | SEQ ID 1545 | NM_018119 | HS polymerase (RNA) III (DNA directed) polypeptide E (80 kD) (POLR3E), tv1, mRNA. |
| POLR3E | exonic | SEQ ID 1546 | NM_001258036 | HS polymerase (RNA) III (DNA directed) polypeptide E (80 kD) (POLR3E), tv5, mRNA. |
| POLR3E | exonic | SEQ ID 1547 | NM_001258035 | HS polymerase (RNA) III (DNA directed) polypeptide E (80 kD) (POLR3E), tv3, mRNA. |
| POLR3E | exonic | SEQ ID 1548 | NM_001258034 | HS polymerase (RNA) III (DNA directed) polypeptide E (80 kD) (POLR3E), tv4, mRNA. |
| POLR3E | exonic | SEQ ID 1549 | NM_001258033 | HS polymerase (RNA) III (DNA directed) polypeptide E (80 kD) (POLR3E), tv2, mRNA. |
| POLR3E | exonic | SEQ ID 1550 | NR_047581 | HS polymerase (RNA) III (DNA directed) polypeptide E (80 kD) (POLR3E), tv6, non-coding RNA. |
| CETN3 | exonic | SEQ ID 1551 | NM_004365 | HS centrin, EF-hand protein, 3 (CETN3), mRNA. |
| MBLAC2 | exonic | SEQ ID 1552 | NM_203406 | HS metallo-beta-lactamase domain containing 2 (MBLAC2), mRNA. |
| POLR3G | exonic | SEQ ID 1553 | NM_006467 | HS polymerase (RNA) III (DNA directed) polypeptide G (32 kD) (POLR3G), mRNA. |
| LYSMD3 | exonic | SEQ ID 1554 | NM_198273 | HS LysM, putative peptidoglycan-binding, domain containing 3 (LYSMD3), mRNA. |
| CSGALNACT2 | exonic | SEQ ID 1555 | NM_018590 | HS chondroitin sulfate N-acetylgalactosaminyltransferase 2 (CSGALNACT2), mRNA. |
| BMS1 | exonic | SEQ ID 1556 | NM_014753 | HS BMS1 homolog, ribosome assembly protein (yeast) (BMS1), mRNA. |
| ZNF487P | exonic | SEQ ID 1557 | NR_026693 | HS zinc finger protein 487, pseudogene (ZNF487P), non-coding RNA. |
| MIR5100 | exonic | SEQ ID 1558 | NR_049836 | HS microRNA 5100 (MIR5100), microRNA. |
| RET | exonic | SEQ ID 1559 | NM_020630 | HS ret proto-oncogene (RET), tv4, mRNA. |
| RET | exonic | SEQ ID 1560 | NM_020975 | HS ret proto-oncogene (RET), tv2, mRNA. |
| RASGEF1A | exonic | SEQ ID 1561 | NM_145313 | HS RasGEF domain family, member 1A (RASGEF1A), mRNA. |
| HNRNPF | exonic | SEQ ID 1562 | NM_001098208 | HS heterogeneous nuclear ribonucleoprotein F (HNRNPF), tv1, mRNA. |
| FXYD4 | exonic | SEQ ID 1563 | NM_001184963 | HS FXYD domain containing ion transport regulator 4 (FXYD4), tv2, mRNA. |
| HNRNPF | exonic | SEQ ID 1564 | NM_001098206 | HS heterogeneous nuclear ribonucleoprotein F (HNRNPF), tv5, mRNA. |
| HNRNPF | exonic | SEQ ID 1565 | NM_001098205 | HS heterogeneous nuclear ribonucleoprotein F (HNRNPF), tv4, mRNA. |
| HNRNPF | exonic | SEQ ID 1566 | NM_001098204 | HS heterogeneous nuclear ribonucleoprotein F (HNRNPF), tv2, mRNA. |
| HNRNPF | exonic | SEQ ID 1567 | NM_001098207 | HS heterogeneous nuclear ribonucleoprotein F (HNRNPF), tv6, mRNA. |
| HNRNPF | exonic | SEQ ID 1568 | NM_004966 | HS heterogeneous nuclear ribonucleoprotein F (HNRNPF), tv3, mRNA. |
| FXYD4 | exonic | SEQ ID 1569 | NM_173160 | HS FXYD domain containing ion transport regulator 4 (FXYD4), tv1, mRNA. |
| LOC441666 | exonic | SEQ ID 1570 | NR_024380 | HS zinc finger protein 91 pseudogene (LOC441666), non-coding RNA. |
| LINC00839 | ncRNA | SEQ ID 1571 | NR_026827 | HS long intergenic non-protein coding RNA 839 (LINC00839), non-coding RNA. |
| ZNF33B | exonic | SEQ ID 1572 | NM_006955 | HS zinc finger protein 33B (ZNF33B), mRNA. |
| ARHGAP10 | exonic | SEQ ID 1573 | NM_024605 | HS Rho GTPase activating protein 10 (ARHGAP10), mRNA. |
| CEP57 | exonic | SEQ ID 1574 | NM_001243777 | HS centrosomal protein 57 kDa (CEP57), tv3, mRNA. |
| CEP57 | exonic | SEQ ID 1575 | NM_001243776 | HS centrosomal protein 57 kDa (CEP57), tv2, mRNA. |
| CEP57 | exonic | SEQ ID 1576 | NM_014679 | HS centrosomal protein 57 kDa (CEP57), tv1, mRNA. |
| GRAMD4 | exonic | SEQ ID 1577 | NM_015124 | HS GRAM domain containing 4 (GRAMD4), mRNA. |
| OFD1 | exonic | SEQ ID 1578 | NM_003611 | HS oral-facial-digital syndrome 1 (OFD1), mRNA. |
| SLC25A29 | exonic | SEQ ID 1579 | NM_001039355 | HS solute carrier family 25 (mitochondrial carnitine/acylcarnitine carrier), member 29 (SLC25A29), nuclear gene encoding mitochondrial protein, mRNA. |
| CD46 | exonic | SEQ ID 1580 | NM_002389 | HS CD46 molecule, complement regulatory protein (CD46), tva, mRNA. |
| CD46 | exonic | SEQ ID 1581 | NM_172350 | HS CD46 molecule, complement regulatory protein (CD46), tvn, mRNA. |
| CD46 | exonic | SEQ ID 1582 | NM_172359 | HS CD46 molecule, complement regulatory protein (CD46), tvb, mRNA. |
| CD46 | exonic | SEQ ID 1583 | NM_172351 | HS CD46 molecule, complement regulatory protein (CD46), tvc, mRNA. |
| CD46 | exonic | SEQ ID 1584 | NM_172361 | HS CD46 molecule, complement regulatory protein (CD46), tvl, mRNA. |
| CD46 | exonic | SEQ ID 1585 | NM_172353 | HS CD46 molecule, complement regulatory protein (CD46), tvf, mRNA. |
| CD46 | exonic | SEQ ID 1586 | NM_153826 | HS CD46 molecule, complement regulatory protein (CD46), tvd, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| CD46 | exonic | SEQ ID 1587 | NM_172352 | HS CD46 molecule, complement regulatory protein (CD46), tve, mRNA. |
| AP3M2 | exonic | SEQ ID 1588 | NM_006803 | HS adaptor-related protein complex 3, mu 2 subunit (AP3M2), tv2, mRNA. |
| AP3M2 | exonic | SEQ ID 1589 | NM_001134296 | HS adaptor-related protein complex 3, mu 2 subunit (AP3M2), tv1, mRNA. |
| MIR516B2 | exonic | SEQ ID 1590 | NR_030207 | HS microRNA 516b-2 (MIR516B2), microRNA. |
| OR6Y1 | exonic | SEQ ID 1591 | NM_001005189 | HS olfactory receptor, family 6, subfamily Y, member 1 (OR6Y1), mRNA. |
| CLOCK | exonic | SEQ ID 1592 | NM_004898 | HS clock circadian regulator (CLOCK), tv2, mRNA. |
| CLOCK | exonic | SEQ ID 1593 | NM_001267843 | HS clock circadian regulator (CLOCK), tv1, mRNA. |
| SESTD1 | exonic | SEQ ID 1594 | NM_178123 | HS SEC14 and spectrin domains 1 (SESTD1), mRNA. |
| FER1L4 | exonic | SEQ ID 1595 | NR_024377 | HS fer-1-like 4 (C. elegans) pseudogene (FER1L4), non-coding RNA. |
| USP9X | exonic | SEQ ID 1596 | NM_001039591 | HS ubiquitin specific peptidase 9, X-linked (USP9X), tv4, mRNA. |
| USP9X | exonic | SEQ ID 1597 | NM_001039590 | HS ubiquitin specific peptidase 9, X-linked (USP9X), tv3, mRNA. |
| CLECL1 | exonic | SEQ ID 1598 | NM_001253750 | HS C-type lectin-like 1 (CLECL1), tv3, mRNA. |
| CLECL1 | exonic | SEQ ID 1599 | NM_001253701 | HS C-type lectin-like 1 (CLECL1), tv4, mRNA. |
| CLECL1 | exonic | SEQ ID 1600 | NM_172004 | HS C-type lectin-like 1 (CLECL1), tv1, mRNA. |
| XPO6 | exonic | SEQ ID 1601 | NM_015171 | HS exportin 6 (XPO6), tv2, mRNA. |
| XPO6 | exonic | SEQ ID 1602 | NM_001270940 | HS exportin 6 (XPO6), tv1, mRNA. |
| ARHGEF26 | exonic | SEQ ID 1603 | NM_015595 | HS Rho guanine nucleotide exchange factor (GEF) 26 (ARHGEF26), tv2, mRNA. |
| ARHGEF26 | exonic | SEQ ID 1604 | NM_001251962 | HS Rho guanine nucleotide exchange factor (GEF) 26 (ARHGEF26), tv1, mRNA. |
| ARHGEF26 | exonic | SEQ ID 1605 | NM_001251963 | HS Rho guanine nucleotide exchange factor (GEF) 26 (ARHGEF26), tv3, mRNA. |
| TRIO | exonic | SEQ ID 1606 | NM_007118 | HS trio Rho guanine nucleotide exchange factor (TRIO), mRNA. |
| ANO5 | exonic | SEQ ID 1607 | NM_213599 | HS anoctamin 5 (ANO5), tv1, mRNA. |
| ANO5 | exonic | SEQ ID 1608 | NM_001142649 | HS anoctamin 5 (ANO5), tv2, mRNA. |
| KIRREL3 | exonic | SEQ ID 1609 | NM_001161707 | HS kin of IRRE like 3 (Drosophila) (KIRREL3), tv2, mRNA. |
| KIRREL3 | exonic | SEQ ID 1610 | NM_032531 | HS kin of IRRE like 3 (Drosophila) (KIRREL3), tv1, mRNA. |
| LBH | exonic | SEQ ID 1611 | NM_030915 | HS limb bud and heart development (LBH), mRNA. |
| IL1RAPL1 | exonic | SEQ ID 1612 | NM_014271 | HS interleukin 1 receptor accessory protein-like 1 (IL1RAPL1), mRNA. |
| ETS1 | exonic | SEQ ID 1613 | NM_001143820 | HS v-ets erythroblastosis virus E26 oncogene homolog 1 (avian) (ETS1), tv1, mRNA. |
| ETS1 | exonic | SEQ ID 1614 | NM_005238 | HS v-ets erythroblastosis virus E26 oncogene homolog 1 (avian) (ETS1), tv2, mRNA. |
| ETS1 | exonic | SEQ ID 1615 | NM_001162422 | HS v-ets erythroblastosis virus E26 oncogene homolog 1 (avian) (ETS1), tv3, mRNA. |
| CXorf57 | exonic | SEQ ID 1616 | NM_018015 | HS chromosome X open reading frame 57 (CXorf57), tv1, mRNA. |
| CXorf57 | exonic | SEQ ID 1617 | NM_001184782 | HS chromosome X open reading frame 57 (CXorf57), tv2, mRNA. |
| HECTD1 | exonic | SEQ ID 1618 | NM_015382 | HS HECT domain containing E3 ubiquitin protein ligase 1 (HECTD1), mRNA. |
| ST6GAL2 | exonic | SEQ ID 1619 | NM_001142351 | HS ST6 beta-galactosamide alpha-2,6-sialyltranferase 2 (ST6GAL2), tv2, mRNA. |
| ST6GAL2 | exonic | SEQ ID 1620 | NM_032528 | HS ST6 beta-galactosamide alpha-2,6-sialyltranferase 2 (ST6GAL2), tv1, mRNA. |
| COMMD7 | exonic | SEQ ID 1621 | NM_053041 | HS COMM domain containing 7 (COMMD7), tv1, mRNA. |
| COMMD7 | exonic | SEQ ID 1622 | NM_001099339 | HS COMM domain containing 7 (COMMD7), tv2, mRNA. |
| FANCA | exonic | SEQ ID 1623 | NM_000135 | HS Fanconi anemia, complementation group A (FANCA), tv1, mRNA. |
| FANCA | exonic | SEQ ID 1624 | NM_001018112 | HS Fanconi anemia, complementation group A (FANCA), tv2, mRNA. |
| PYROXD1 | exonic | SEQ ID 1625 | NM_024854 | HS pyridine nucleotide-disulphide oxidoreductase domain 1 (PYROXD1), mRNA. |
| RECQL | exonic | SEQ ID 1626 | NM_032941 | HS RecQ protein-like (DNA helicase Q1-like) (RECQL), tv2, mRNA. |
| RECQL | exonic | SEQ ID 1627 | NM_002907 | HS RecQ protein-like (DNA helicase Q1-like) (RECQL), tv1, mRNA. |
| CSDAP1 | exonic | SEQ ID 1628 | NR_027011 | HS cold shock domain protein A pseudogene 1 (CSDAP1), non-coding RNA. |
| LOC158696 | exonic | SEQ ID 1629 | NR_026935 | HS uncharacterized LOC158696 (LOC158696), non-coding RNA. |
| PMS2 | exonic | SEQ ID 1630 | NM_000535 | HS PMS2 postmeiotic segregation increased 2 (S. cerevisiae) (PMS2), tv1, mRNA. |
| PMS2 | exonic | SEQ ID 1631 | NR_003085 | HS PMS2 postmeiotic segregation increased 2 (S. cerevisiae) (PMS2), tv2, non-coding RNA. |
| CCDC18 | exonic | SEQ ID 1632 | NM_206886 | HS coiled-coil domain containing 18 (CCDC18), mRNA. |
| PREPL | exonic | SEQ ID 1633 | NM_001042385 | HS prolyl endopeptidase-like (PREPL), tv4, mRNA. |
| PREPL | exonic | SEQ ID 1634 | NM_001171617 | HS prolyl endopeptidase-like (PREPL), tv7, mRNA. |
| PREPL | exonic | SEQ ID 1635 | NM_001042386 | HS prolyl endopeptidase-like (PREPL), tv5, mRNA. |
| PREPL | exonic | SEQ ID 1636 | NM_001171603 | HS prolyl endopeptidase-like (PREPL), tv2, mRNA. |
| PREPL | exonic | SEQ ID 1637 | NM_001171613 | HS prolyl endopeptidase-like (PREPL), tv6, mRNA. |
| PREPL | exonic | SEQ ID 1638 | NM_001171606 | HS prolyl endopeptidase-like (PREPL), tv3, mRNA. |
| PREPL | exonic | SEQ ID 1639 | NM_006036 | HS prolyl endopeptidase-like (PREPL), tv1, mRNA. |
| HOMEZ | exonic | SEQ ID 1640 | NM_020834 | HS homeobox and leucine zipper encoding (HOMEZ), mRNA. |
| UBR1 | exonic | SEQ ID 1641 | NM_174916 | HS ubiquitin protein ligase E3 component n-recognin 1 (UBR1), mRNA. |
| APOBEC3C | exonic | SEQ ID 1642 | NM_014508 | HS apolipoprotein B mRNA editing enzyme, catalytic polypeptide-like 3C (APOBEC3C), mRNA. |
| PNLIPRP3 | exonic | SEQ ID 1643 | NM_001011709 | HS pancreatic lipase-related protein 3 (PNLIPRP3), mRNA. |
| DDX58 | exonic | SEQ ID 1644 | NM_014314 | HS DEAD (Asp-Glu-Ala-Asp) box polypeptide 58 (DDX58), mRNA. |
| MYBL1 | exonic | SEQ ID 1645 | NM_001080416 | HS v-myb myeloblastosis viral oncogene homolog (avian)-like 1 (MYBL1), tv1, mRNA. |
| MYBL1 | exonic | SEQ ID 1646 | NM_001144755 | HS v-myb myeloblastosis viral oncogene homolog (avian)-like 1 (MYBL1), tv2, mRNA. |
| GIT2 | exonic | SEQ ID 1647 | NM_014776 | HS G protein-coupled receptor kinase interacting ArfGAP 2 (GIT2), tv3, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| GIT2 | exonic | SEQ ID 1648 | NM_139201 | HS G protein-coupled receptor kinase interacting ArfGAP 2 (GIT2), tv4, mRNA. |
| GIT2 | exonic | SEQ ID 1649 | NM_057170 | HS G protein-coupled receptor kinase interacting ArfGAP 2 (GIT2), tv2, mRNA. |
| GIT2 | exonic | SEQ ID 1650 | NM_001135213 | HS G protein-coupled receptor kinase interacting ArfGAP 2 (GIT2), tv6, mRNA. |
| GIT2 | exonic | SEQ ID 1651 | NM_001135214 | HS G protein-coupled receptor kinase interacting ArfGAP 2 (GIT2), tv5, mRNA. |
| GIT2 | exonic | SEQ ID 1652 | NM_057169 | HS G protein-coupled receptor kinase interacting ArfGAP 2 (GIT2), tv1, mRNA. |
| RGS20 | exonic | SEQ ID 1653 | NM_003702 | HS regulator of G-protein signaling 20 (RGS20), tv2, mRNA. |
| RGS20 | exonic | SEQ ID 1654 | NM_170587 | HS regulator of G-protein signaling 20 (RGS20), tv1, mRNA. |
| ALS2CL | exonic | SEQ ID 1655 | NM_182775 | HS ALS2 C-terminal like (ALS2CL), tv3, mRNA. |
| ALS2CL | exonic | SEQ ID 1656 | NM_147129 | HS ALS2 C-terminal like (ALS2CL), tv1, mRNA. |
| ALS2CL | exonic | SEQ ID 1657 | NM_001190707 | HS ALS2 C-terminal like (ALS2CL), tv2, mRNA. |
| ALS2CL | exonic | SEQ ID 1658 | NR_033815 | HS ALS2 C-terminal like (ALS2CL), tv4, non-coding RNA. |
| BTG4 | exonic | SEQ ID 1659 | NM_017589 | HS B-cell translocation gene 4 (BTG4), mRNA. |
| FAM9B | exonic | SEQ ID 1660 | NM_205849 | HS family with sequence similarity 9, member B (FAM9B), mRNA. |
| ABCA13 | exonic | SEQ ID 1661 | NM_152701 | HS ATP-binding cassette, sub-family A (ABC1), member 13 (ABCA13), mRNA. |
| LOC255025 | exonic | SEQ ID 1662 | NR_015400 | HS uncharacterized LOC255025 (LOC255025), non-coding RNA. |
| AKR1B15 | exonic | SEQ ID 1663 | NM_001080538 | HS aldo-keto reductase family 1, member B15 (AKR1B15), mRNA. |
| GLDC | exonic | SEQ ID 1664 | NM_000170 | HS glycine dehydrogenase (decarboxylating) (GLDC), nuclear gene encoding mitochondrial protein, mRNA. |
| LINC00671 | exonic | SEQ ID 1665 | NR_027254 | HS long intergenic non-protein coding RNA 671 (LINC00671), non-coding RNA. |
| UBA6 | exonic | SEQ ID 1666 | NM_018227 | HS ubiquitin-like modifier activating enzyme 6 (UBA6), mRNA. |
| T | exonic | SEQ ID 1667 | NM_003181 | HS T, brachyury homolog (mouse) (T), tv1, mRNA. |
| T | exonic | SEQ ID 1668 | NM_001270484 | HS T, brachyury homolog (mouse) (T), tv2, mRNA. |
| STAT3 | exonic | SEQ ID 1669 | NM_213662 | HS signal transducer and activator of transcription 3 (acute-phase response factor) (STAT3), tv3, mRNA. |
| STAT3 | exonic | SEQ ID 1670 | NM_139276 | HS signal transducer and activator of transcription 3 (acute-phase response factor) (STAT3), tv1, mRNA. |
| STAT3 | exonic | SEQ ID 1671 | NM_003150 | HS signal transducer and activator of transcription 3 (acute-phase response factor) (STAT3), tv2, mRNA. |
| TBCK | exonic | SEQ ID 1672 | NM_001163435 | HS TBC1 domain containing kinase (TBCK), tv1, mRNA. |
| TBCK | exonic | SEQ ID 1673 | NM_001163437 | HS TBC1 domain containing kinase (TBCK), tv3, mRNA. |
| TBCK | exonic | SEQ ID 1674 | NM_001163436 | HS TBC1 domain containing kinase (TBCK), tv2, mRNA. |
| TBCK | exonic | SEQ ID 1675 | NM_033115 | HS TBC1 domain containing kinase (TBCK), tv4, mRNA. |
| N4BP2 | exonic | SEQ ID 1676 | NM_018177 | HS NEDD4 binding protein 2 (N4BP2), mRNA. |
| CADPS2 | exonic | SEQ ID 1677 | NM_001167940 | HS Ca++-dependent secretion activator 2 (CADPS2), tv3, mRNA. |
| CADPS2 | exonic | SEQ ID 1678 | NM_001009571 | HS Ca++-dependent secretion activator 2 (CADPS2), tv2, mRNA. |
| CADPS2 | exonic | SEQ ID 1679 | NM_017954 | HS Ca++-dependent secretion activator 2 (CADPS2), tv1, mRNA. |
| GNE | exonic | SEQ ID 1680 | NM_001128227 | HS glucosamine (UDP-N-acetyl)-2-epimerase/N-acetylmannosamine kinase (GNE), tv1, mRNA. |
| GNE | exonic | SEQ ID 1681 | NM_001190388 | HS glucosamine (UDP-N-acetyl)-2-epimerase/N-acetylmannosamine kinase (GNE), tv3, mRNA. |
| GATA6 | exonic | SEQ ID 1682 | NM_005257 | HS GATA binding protein 6 (GATA6), mRNA. |
| SLC27A6 | exonic | SEQ ID 1683 | NM_014031 | HS solute carrier family 27 (fatty acid transporter), member 6 (SLC27A6), tv1, mRNA. |
| SLC27A6 | exonic | SEQ ID 1684 | NM_001017372 | HS solute carrier family 27 (fatty acid transporter), member 6 (SLC27A6), tv2, mRNA. |
| KIF26B | exonic | SEQ ID 1685 | NM_018012 | HS kinesin family member 26B (KIF26B), mRNA. |
| MIR3680-2 | exonic | SEQ ID 1686 | NR_049833 | HS microRNA 3680-2 (MIR3680-2), microRNA. |
| MIR3680-1 | exonic | SEQ ID 1687 | NR_037451 | HS microRNA 3680-1 (MIR3680-1), microRNA. |
| RARRES3 | exonic | SEQ ID 1688 | NM_004585 | HS retinoic acid receptor responder (tazarotene induced) 3 (RARRES3), mRNA. |
| SPECC1 | exonic | SEQ ID 1689 | NM_001243439 | HS sperm antigen with calponin homology and coiled-coil domains 1 (SPECC1), tv6, mRNA. |
| SPECC1 | exonic | SEQ ID 1690 | NM_001033555 | HS sperm antigen with calponin homology and coiled-coil domains 1 (SPECC1), tv2, mRNA. |
| SPECC1 | exonic | SEQ ID 1691 | NM_001033553 | HS sperm antigen with calponin homology and coiled-coil domains 1 (SPECC1), tv1, mRNA. |
| IRAK2 | exonic | SEQ ID 1692 | NM_001570 | HS interleukin-1 receptor-associated kinase 2 (IRAK2), mRNA. |
| NDRG1 | exonic | SEQ ID 1693 | NM_006096 | HS N-myc downstream regulated 1 (NDRG1), tv2, mRNA. |
| NDRG1 | exonic | SEQ ID 1694 | NM_001135242 | HS N-myc downstream regulated 1 (NDRG1), tv1, mRNA. |
| NDRG1 | exonic | SEQ ID 1695 | NM_001258432 | HS N-myc downstream regulated 1 (NDRG1), tv3, mRNA. |
| NDRG1 | exonic | SEQ ID 1696 | NM_001258433 | HS N-myc downstream regulated 1 (NDRG1), tv4, mRNA. |
| ATAD5 | exonic | SEQ ID 1697 | NM_024857 | HS ATPase family, AAA domain containing 5 (ATAD5), mRNA. |
| CD109 | exonic | SEQ ID 1698 | NM_001159588 | HS CD109 molecule (CD109), tv3, mRNA. |
| CD109 | exonic | SEQ ID 1699 | NM_001159587 | HS CD109 molecule (CD109), tv2, mRNA. |
| CD109 | exonic | SEQ ID 1700 | NM_133493 | HS CD109 molecule (CD109), tv1, mRNA. |
| DNAH3 | exonic | SEQ ID 1701 | NM_017539 | HS dynein, axonemal, heavy chain 3 (DNAH3), mRNA. |
| POU5F1P3 | exonic | SEQ ID 1702 | NR_036440 | HS POU class 5 homeobox 1 pseudogene 3 (POU5F1P3), non-coding RNA. |
| CLEC4A | exonic | SEQ ID 1703 | NM_194450 | HS C-type lectin domain family 4, member A (CLEC4A), tv2, mRNA. |
| CLEC4A | exonic | SEQ ID 1704 | NM_194448 | HS C-type lectin domain family 4, member A (CLEC4A), tv4, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| CLEC4A | exonic | SEQ ID 1705 | NM_194447 | HS C-type lectin domain family 4, member A (CLEC4A), tv3, mRNA. |
| CLEC4A | exonic | SEQ ID 1706 | NM_016184 | HS C-type lectin domain family 4, member A (CLEC4A), tv1, mRNA. |
| PLAA | exonic | SEQ ID 1707 | NM_001031689 | HS phospholipase A2-activating protein (PLAA), mRNA. |
| GLRX | exonic | SEQ ID 1708 | NM_001118890 | HS glutaredoxin (thioltransferase) (GLRX), tv2, mRNA. |
| GLRX | exonic | SEQ ID 1709 | NM_001243659 | HS glutaredoxin (thioltransferase) (GLRX), tv4, mRNA. |
| GLRX | exonic | SEQ ID 1710 | NM_002064 | HS glutaredoxin (thioltransferase) (GLRX), tv1, mRNA. |
| GLRX | exonic | SEQ ID 1711 | NM_001243658 | HS glutaredoxin (thioltransferase) (GLRX), tv3, mRNA. |
| ALG12 | exonic | SEQ ID 1712 | NM_024105 | HS asparagine-linked glycosylation 12, alpha-1,6-mannosyltransferase homolog (S. cerevisiae) (ALG12), mRNA. |
| GUSBP11 | exonic | SEQ ID 1713 | NR_024448 | HS glucuronidase, beta pseudogene 11 (GUSBP11), non-coding RNA. |
| RGL4 | exonic | SEQ ID 1714 | NM_153615 | HS ral guanine nucleotide dissociation stimulator-like 4 (RGL4), mRNA. |
| PDE10A | exonic | SEQ ID 1715 | NM_001130690 | HS phosphodiesterase 10A (PDE10A), tv1, mRNA. |
| PDE10A | exonic | SEQ ID 1716 | NR_045597 | HS phosphodiesterase 10A (PDE10A), tv2, non-coding RNA. |
| ANKS1B | exonic | SEQ ID 1717 | NM_152788 | HS ankyrin repeat and sterile alpha motif domain containing 1B (ANKS1B), tv1, mRNA. |
| ANKS1B | exonic | SEQ ID 1718 | NM_001204068 | HS ankyrin repeat and sterile alpha motif domain containing 1B (ANKS1B), tv7, mRNA. |
| ANKS1B | exonic | SEQ ID 1719 | NM_001204066 | HS ankyrin repeat and sterile alpha motif domain containing 1B (ANKS1B), tv5, mRNA. |
| ANKS1B | exonic | SEQ ID 1720 | NM_001204065 | HS ankyrin repeat and sterile alpha motif domain containing 1B (ANKS1B), tv4, mRNA. |
| ANKS1B | exonic | SEQ ID 1721 | NM_001204080 | HS ankyrin repeat and sterile alpha motif domain containing 1B (ANKS1B), tv11, mRNA. |
| ANKS1B | exonic | SEQ ID 1722 | NM_001204070 | HS ankyrin repeat and sterile alpha motif domain containing 1B (ANKS1B), tv9, mRNA. |
| ANKS1B | exonic | SEQ ID 1723 | NM_001204079 | HS ankyrin repeat and sterile alpha motif domain containing 1B (ANKS1B), tv10, mRNA. |
| ANKS1B | exonic | SEQ ID 1724 | NM_001204067 | HS ankyrin repeat and sterile alpha motif domain containing 1B (ANKS1B), tv6, mRNA. |
| ANKS1B | exonic | SEQ ID 1725 | NM_001204069 | HS ankyrin repeat and sterile alpha motif domain containing 1B (ANKS1B), tv8, mRNA. |
| ANKS1B | exonic | SEQ ID 1726 | NM_020140 | HS ankyrin repeat and sterile alpha motif domain containing 1B (ANKS1B), tv3, mRNA. |
| ANKS1B | exonic | SEQ ID 1727 | NM_181670 | HS ankyrin repeat and sterile alpha motif domain containing 1B (ANKS1B), tv2, mRNA. |
| ANKS1B | exonic | SEQ ID 1728 | NM_001204081 | HS ankyrin repeat and sterile alpha motif domain containing 1B (ANKS1B), tv12, mRNA. |
| CECR2 | exonic | SEQ ID 1729 | NM_031413 | HS cat eye syndrome chromosome region, candidate 2 (CECR2), mRNA. |
| TAS1R2 | exonic | SEQ ID 1730 | NM_152232 | HS taste receptor, type 1, member 2 (TAS1R2), mRNA. |
| NUP155 | exonic | SEQ ID 1731 | NM_004298 | HS nucleoporin 155 kDa (NUP155), tv2, mRNA. |
| NUP155 | exonic | SEQ ID 1732 | NM_153485 | HS nucleoporin 155 kDa (NUP155), tv1, mRNA. |
| STIL | exonic | SEQ ID 1733 | NM_003035 | HS SCL/TAL1 interrupting locus (STIL), tv2, mRNA. |
| STIL | exonic | SEQ ID 1734 | NM_001048166 | HS SCL/TAL1 interrupting locus (STIL), tv1, mRNA. |
| STPG2 | exonic | SEQ ID 1735 | NM_174952 | HS sperm-tail PG-rich repeat containing 2 (STPG2), mRNA. |
| PDLIM3 | exonic | SEQ ID 1736 | NM_001257962 | HS PDZ and LIM domain 3 (PDLIM3), tv3, mRNA. |
| PDLIM3 | exonic | SEQ ID 1737 | NM_001114107 | HS PDZ and LIM domain 3 (PDLIM3), tv2, mRNA. |
| PDLIM3 | exonic | SEQ ID 1738 | NR_047562 | HS PDZ and LIM domain 3 (PDLIM3), tv5, non-coding RNA. |
| PDLIM3 | exonic | SEQ ID 1739 | NM_014476 | HS PDZ and LIM domain 3 (PDLIM3), tv1, mRNA. |
| PDLIM3 | exonic | SEQ ID 1740 | NM_001257963 | HS PDZ and LIM domain 3 (PDLIM3), tv4, mRNA. |
| YIPF7 | exonic | SEQ ID 1741 | NM_182592 | HS Yip1 domain family, member 7 (YIPF7), mRNA. |
| CCDC169-SOHLH2 | exonic | SEQ ID 1742 | NM_001198910 | HS CCDC169-SOHLH2 readthrough (CCDC169-SOHLH2), mRNA. |
| CCDC169 | exonic | SEQ ID 1743 | NM_001144983 | HS coiled-coil domain containing 169 (CCDC169), tv3, mRNA. |
| CCDC169 | exonic | SEQ ID 1744 | NM_001198908 | HS coiled-coil domain containing 169 (CCDC169), tv7, mRNA. |
| CCDC169 | exonic | SEQ ID 1745 | NM_001144984 | HS coiled-coil domain containing 169 (CCDC169), tv4, mRNA. |
| CCDC169 | exonic | SEQ ID 1746 | NM_001144982 | HS coiled-coil domain containing 169 (CCDC169), tv2, mRNA. |
| PLA2G15 | exonic | SEQ ID 1747 | NM_012320 | HS phospholipase A2, group XV (PLA2G15), mRNA. |
| CYB5R1 | exonic | SEQ ID 1748 | NM_016243 | HS cytochrome b5 reductase 1 (CYB5R1), mRNA. |
| DHPS | exonic | SEQ ID 1749 | NM_013406 | HS deoxyhypusine synthase (DHPS), tv2, mRNA. |
| DHPS | exonic | SEQ ID 1750 | NM_001930 | HS deoxyhypusine synthase (DHPS), tv1, mRNA. |
| DHPS | exonic | SEQ ID 1751 | NM_001206974 | HS deoxyhypusine synthase (DHPS), tv4, mRNA. |
| DHPS | exonic | SEQ ID 1752 | NR_038192 | HS deoxyhypusine synthase (DHPS), tv5, non-coding RNA. |
| RIIAD1 | exonic | SEQ ID 1753 | NM_001144956 | HS regulatory subunit of type II PKA R-subunit (RIIa) domain containing 1 (RIIAD1), mRNA. |
| FBXW9 | exonic | SEQ ID 1754 | NM_032301 | HS F-box and WD repeat domain containing 9 (FBXW9), mRNA. |
| CNTLN | exonic | SEQ ID 1755 | NM_017738 | HS centlein, centrosomal protein (CNTLN), tv1, mRNA. |
| SNX16 | exonic | SEQ ID 1756 | NM_152837 | HS sorting nexin 16 (SNX16), tv3, mRNA. |
| SNX16 | exonic | SEQ ID 1757 | NM_152836 | HS sorting nexin 16 (SNX16), tv2, mRNA. |
| SNX16 | exonic | SEQ ID 1758 | NM_022133 | HS sorting nexin 16 (SNX16), tv1, mRNA. |
| SOAT1 | exonic | SEQ ID 1759 | NM_001252511 | HS sterol O-acyltransferase 1 (SOAT1), nuclear gene encoding mitochondrial protein, tv2, mRNA. |
| SOAT1 | exonic | SEQ ID 1760 | NM_001252512 | HS sterol O-acyltransferase 1 (SOAT1), nuclear gene encoding mitochondrial protein, tv3, mRNA. |
| SOAT1 | exonic | SEQ ID 1761 | NM_003101 | HS sterol O-acyltransferase 1 (SOAT1), nuclear gene encoding mitochondrial protein, tv1, mRNA. |
| SOAT1 | exonic | SEQ ID 1762 | NR_045530 | HS sterol O-acyltransferase 1 (SOAT1), tv4, non-coding RNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| ABCB4 | exonic | SEQ ID 1763 | NM_000443 | HS ATP-binding cassette, sub-family B (MDR/TAP), member 4 (ABCB4), tvA, mRNA. |
| ABCB4 | exonic | SEQ ID 1764 | NM_018849 | HS ATP-binding cassette, sub-family B (MDR/TAP), member 4 (ABCB4), tvB, mRNA. |
| ABCB4 | exonic | SEQ ID 1765 | NM_018850 | HS ATP-binding cassette, sub-family B (MDR/TAP), member 4 (ABCB4), tvC, mRNA. |
| CASP10 | exonic | SEQ ID 1766 | NM_032974 | HS caspase 10, apoptosis-related cysteine peptidase (CASP10), tv2, mRNA. |
| CASP10 | exonic | SEQ ID 1767 | NM_001206524 | HS caspase 10, apoptosis-related cysteine peptidase (CASP10), tv6, mRNA. |
| CASP10 | exonic | SEQ ID 1768 | NM_032977 | HS caspase 10, apoptosis-related cysteine peptidase (CASP10), tv1, mRNA. |
| CASP10 | exonic | SEQ ID 1769 | NM_001230 | HS caspase 10, apoptosis-related cysteine peptidase (CASP10), tv3, mRNA. |
| CASP10 | exonic | SEQ ID 1770 | NM_032976 | HS caspase 10, apoptosis-related cysteine peptidase (CASP10), tv4, mRNA. |
| CASP10 | exonic | SEQ ID 1771 | NM_001206542 | HS caspase 10, apoptosis-related cysteine peptidase (CASP10), tv5, mRNA. |
| MYO18B | exonic | SEQ ID 1772 | NM_032608 | HS myosin XVIIIB (MYO18B), mRNA. |
| MIR1302-1 | exonic | SEQ ID 1773 | NR_031631 | HS microRNA 1302-1 (MIR1302-1), microRNA. |
| DPYD | exonic | SEQ ID 1774 | NM_000110 | HS dihydropyrimidine dehydrogenase (DPYD), tv1, mRNA. |
| STON1 | exonic | SEQ ID 1775 | NM_001198595 | HS stonin 1 (STON1), tv1, mRNA. |
| STON1 | exonic | SEQ ID 1776 | NM_006873 | HS stonin 1 (STON1), tv2, mRNA. |
| STON1-GTF2A1L | exonic | SEQ ID 1777 | NM_001198593 | HS STON1-GTF2A1L readthrough (STON1-GTF2A1L), tv2, mRNA. |
| STON1-GTF2A1L | exonic | SEQ ID 1778 | NM_001198594 | HS STON1-GTF2A1L readthrough (STON1-GTF2A1L), tv3, mRNA. |
| STON1-GTF2A1L | exonic | SEQ ID 1779 | NM_172311 | HS STON1-GTF2A1L readthrough (STON1-GTF2A1L), tv1, mRNA. |
| CNTLN | exonic | SEQ ID 1780 | NM_001114395 | HS centlein, centrosomal protein (CNTLN), tv2, mRNA. |
| CACNA2D3 | exonic | SEQ ID 1781 | NM_018398 | HS calcium channel, voltage-dependent, alpha 2/delta subunit 3 (CACNA2D3), mRNA. |
| BID | exonic | SEQ ID 1782 | NM_001196 | HS BH3 interacting domain death agonist (BID), tv2, mRNA. |
| BID | exonic | SEQ ID 1783 | NM_197967 | HS BH3 interacting domain death agonist (BID), tv3, mRNA. |
| BID | exonic | SEQ ID 1784 | NM_197966 | HS BH3 interacting domain death agonist (BID), tv1, mRNA. |
| BID | exonic | SEQ ID 1785 | NM_001244572 | HS BH3 interacting domain death agonist (BID), tv7, mRNA. |
| BID | exonic | SEQ ID 1786 | NM_001244570 | HS BH3 interacting domain death agonist (BID), tv6, mRNA. |
| BID | exonic | SEQ ID 1787 | NM_001244569 | HS BH3 interacting domain death agonist (BID), tv5, mRNA. |
| BID | exonic | SEQ ID 1788 | NM_001244567 | HS BH3 interacting domain death agonist (BID), tv4, mRNA. |
| SPECC1 | exonic | SEQ ID 1789 | NM_152904 | HS sperm antigen with calponin homology and coiled-coil domains 1 (SPECC1), tv3, mRNA. |
| ANXA6 | exonic | SEQ ID 1790 | NM_001155 | HS annexin A6 (ANXA6), tv1, mRNA. |
| AQP4-AS1 | exonic | SEQ ID 1791 | NR_026908 | HS AQP4 antisense RNA 1 (AQP4-AS1), non-coding RNA. |
| COL26A1/EMID2 | exonic | SEQ ID 1792 | NM_133457 | HS collagen, type XXVI, alpha 1 (COL26A1), mRNA. |
| EPS8L3 | exonic | SEQ ID 1793 | NM_024526 | HS EPS8-like 3 (EPS8L3), tv3, mRNA. |
| EPS8L3 | exonic | SEQ ID 1794 | NM_133181 | HS EPS8-like 3 (EPS8L3), tv2, mRNA. |
| EPS8L3 | exonic | SEQ ID 1795 | NM_139053 | HS EPS8-like 3 (EPS8L3), tv1, mRNA. |
| PLEKHD1 | exonic | SEQ ID 1796 | NM_001161498 | HS pleckstrin homology domain containing, family D (with coiled-coil domains) member 1 (PLEKHD1), mRNA. |
| ARMC5 | exonic | SEQ ID 1797 | NM_001105247 | HS armadillo repeat containing 5 (ARMC5), tv1, mRNA. |
| TGFB1I1 | exonic | SEQ ID 1798 | NM_001042454 | HS transforming growth factor beta 1 induced transcript 1 (TGFB1I1), tv1, mRNA. |
| TGFB1I1 | exonic | SEQ ID 1799 | NM_015927 | HS transforming growth factor beta 1 induced transcript 1 (TGFB1I1), tv2, mRNA. |
| TGFB1I1 | exonic | SEQ ID 1800 | NM_001164719 | HS transforming growth factor beta 1 induced transcript 1 (TGFB1I1), tv3, mRNA. |
| ARMC5 | exonic | SEQ ID 1801 | NM_024742 | HS armadillo repeat containing 5 (ARMC5), tv2, mRNA. |
| XYLB | exonic | SEQ ID 1802 | NM_005108 | HS xylulokinase homolog (H. influenzae) (XYLB), mRNA. |
| MIR521-2 | exonic | SEQ ID 1803 | NR_030203 | HS microRNA 521-2 (MIR521-2), microRNA. |
| MIR520D | exonic | SEQ ID 1804 | NR_030204 | HS microRNA 520d (MIR520D), microRNA. |
| MIR520G | exonic | SEQ ID 1805 | NR_030206 | HS microRNA 520g (MIR520G), microRNA. |
| MIR517B | exonic | SEQ ID 1806 | NR_030205 | HS microRNA 517b (MIR517B), microRNA. |
| MIR526A2 | exonic | SEQ ID 1807 | NR_030208 | HS microRNA 526a-2 (MIR526A2), microRNA. |
| SZRD1 | exonic | SEQ ID 1808 | NM_015609 | HS SUZ RNA binding domain containing 1 (SZRD1), tv2, mRNA. |
| SZRD1 | exonic | SEQ ID 1809 | NM_001114600 | HS SUZ RNA binding domain containing 1 (SZRD1), tv1, mRNA. |
| ZNF324B | exonic | SEQ ID 1810 | NM_207395 | HS zinc finger protein 324B (ZNF324B), mRNA. |
| CCDC169 | exonic | SEQ ID 1811 | NM_001144986 | HS coiled-coil domain containing 169 (CCDC169), tv6, mRNA. |
| CCDC169 | exonic | SEQ ID 1812 | NM_001144981 | HS coiled-coil domain containing 169 (CCDC169), tv1, mRNA. |
| CCDC169 | exonic | SEQ ID 1813 | NM_001144985 | HS coiled-coil domain containing 169 (CCDC169), tv5, mRNA. |
| RIN1 | exonic | SEQ ID 1814 | NM_004292 | HS Ras and Rab interactor 1 (RIN1), mRNA. |
| ZNF808 | exonic | SEQ ID 1815 | NM_001039886 | HS zinc finger protein 808 (ZNF808), mRNA. |
| EMCN | exonic | SEQ ID 1816 | NM_016242 | HS endomucin (EMCN), tv1, mRNA. |
| EMCN | exonic | SEQ ID 1817 | NM_001159694 | HS endomucin (EMCN), tv2, mRNA. |
| TIAM2 | exonic | SEQ ID 1818 | NM_012454 | HS T-cell lymphoma invasion and metastasis 2 (TIAM2), tv1, mRNA. |
| BCAS1 | exonic | SEQ ID 1819 | NM_003657 | HS breast carcinoma amplified sequence 1 (BCAS1), mRNA. |
| RABEPK | exonic | SEQ ID 1820 | NM_005833 | HS Rab9 effector protein with kelch motifs (RABEPK), tv1, mRNA. |
| RABEPK | exonic | SEQ ID 1821 | NM_001174153 | HS Rab9 effector protein with kelch motifs (RABEPK), tv3, mRNA. |
| RABEPK | exonic | SEQ ID 1822 | NM_001174152 | HS Rab9 effector protein with kelch motifs (RABEPK), tv2, mRNA. |
| KLHDC4 | exonic | SEQ ID 1823 | NM_017566 | HS kelch domain containing 4 (KLHDC4), tv1, mRNA. |
| KLHDC4 | exonic | SEQ ID 1824 | NM_001184856 | HS kelch domain containing 4 (KLHDC4), tv2, mRNA. |
| KLHDC4 | exonic | SEQ ID 1825 | NM_001184854 | HS kelch domain containing 4 (KLHDC4), tv3, mRNA. |
| SEPT9 | exonic | SEQ ID 1826 | NM_001113492 | HS septin 9 (SEPT9), tv5, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| SEPT9 | exonic | SEQ ID 1827 | NM_001113491 | HS septin 9 (SEPT9), tv1, mRNA. |
| SEPT9 | exonic | SEQ ID 1828 | NM_001113493 | HS septin 9 (SEPT9), tv2, mRNA. |
| SEPT9 | exonic | SEQ ID 1829 | NM_006640 | HS septin 9 (SEPT9), tv3, mRNA. |
| SEPT9 | exonic | SEQ ID 1830 | NM_001113496 | HS septin 9 (SEPT9), tv7, mRNA. |
| SEPT9 | exonic | SEQ ID 1831 | NM_001113494 | HS septin 9 (SEPT9), tv6, mRNA. |
| SEPT9 | exonic | SEQ ID 1832 | NM_001113495 | HS septin 9 (SEPT9), tv4, mRNA. |
| KRT6C | exonic | SEQ ID 1833 | NM_173086 | HS keratin 6C (KRT6C), mRNA. |
| BCAP29 | exonic | SEQ ID 1834 | NM_001008405 | HS B-cell receptor-associated protein 29 (BCAP29), tv1, mRNA. |
| BCAP29 | exonic | SEQ ID 1835 | NR_027830 | HS B-cell receptor-associated protein 29 (BCAP29), tv3, non-coding RNA. |
| BCAP29 | exonic | SEQ ID 1836 | NM_018844 | HS B-cell receptor-associated protein 29 (BCAP29), tv2, mRNA. |
| TBCE | exonic | SEQ ID 1837 | NM_003193 | HS tubulin folding cofactor E (TBCE), tv2, mRNA. |
| TBCE | exonic | SEQ ID 1838 | NM_001079515 | HS tubulin folding cofactor E (TBCE), tv1, mRNA. |
| CYP51A1 | exonic | SEQ ID 1839 | NM_000786 | HS cytochrome P450, family 51, subfamily A, polypeptide 1 (CYP51A1), tv1, mRNA. |
| CYP51A1 | exonic | SEQ ID 1840 | NM_001146152 | HS cytochrome P450, family 51, subfamily A, polypeptide 1 (CYP51A1), tv2, mRNA. |
| SYK | exonic | SEQ ID 1841 | NM_001135052 | HS spleen tyrosine kinase (SYK), tv2, mRNA. |
| SYK | exonic | SEQ ID 1842 | NM_001174168 | HS spleen tyrosine kinase (SYK), tv4, mRNA. |
| SYK | exonic | SEQ ID 1843 | NM_003177 | HS spleen tyrosine kinase (SYK), tv1, mRNA. |
| PSMB1 | exonic | SEQ ID 1844 | NM_002793 | HS proteasome (prosome, macropain) subunit, beta type, 1 (PSMB1), mRNA. |
| CEL | exonic | SEQ ID 1845 | NM_001807 | HS carboxyl ester lipase (bile salt-stimulated lipase) (CEL), mRNA. |
| TM4SF19 | exonic | SEQ ID 1846 | NM_138461 | HS transmembrane 4 L six family member 19 (TM4SF19), tv1, mRNA. |
| TM4SF19 | exonic | SEQ ID 1847 | NM_001204898 | HS transmembrane 4 L six family member 19 (TM4SF19), tv3, mRNA. |
| TM4SF19 | exonic | SEQ ID 1848 | NM_001204897 | HS transmembrane 4 L six family member 19 (TM4SF19), tv2, mRNA. |
| CELF3 | exonic | SEQ ID 1849 | NM_001172649 | HS CUGBP, Elav-like family member 3 (CELF3), tv3, mRNA. |
| CELF3 | exonic | SEQ ID 1850 | NM_007185 | HS CUGBP, Elav-like family member 3 (CELF3), tv1, mRNA. |
| CELF3 | exonic | SEQ ID 1851 | NM_001172648 | HS CUGBP, Elav-like family member 3 (CELF3), tv2, mRNA. |
| LOC148696 | exonic | SEQ ID 1852 | NR_026817 | HS uncharacterized LOC148696 (LOC148696), non-coding RNA. |
| VPS53 | exonic | SEQ ID 1853 | NM_018614 | HS vacuolar protein sorting 53 homolog (*S. cerevisiae*) (VPS53), tv2, mRNA. |
| VPS53 | exonic | SEQ ID 1854 | NM_001128159 | HS vacuolar protein sorting 53 homolog (*S. cerevisiae*) (VPS53), tv1, mRNA. |
| RNF168 | exonic | SEQ ID 1855 | NM_152617 | HS ring finger protein 168, E3 ubiquitin protein ligase (RNF168), mRNA. |
| C3orf43 | exonic | SEQ ID 1856 | NM_001077657 | HS chromosome 3 open reading frame 43 (C3orf43), mRNA. |
| OR2T8 | exonic | SEQ ID 1857 | NM_001005522 | HS olfactory receptor, family 2, subfamily T, member 8 (OR2T8), mRNA. |
| DMD | exonic | SEQ ID 1858 | NM_004012 | HS dystrophin (DMD), tvDp260-2, mRNA. |
| DMD | exonic | SEQ ID 1859 | NM_004010 | HS dystrophin (DMD), tvDp427p2, mRNA. |
| DMD | exonic | SEQ ID 1860 | NM_004011 | HS dystrophin (DMD), tvDp260-1, mRNA. |
| DMD | exonic | SEQ ID 1861 | NM_000109 | HS dystrophin (DMD), tvDp427c, mRNA. |
| DMD | exonic | SEQ ID 1862 | NM_004007 | HS dystrophin (DMD), tvDp427l, mRNA. |
| DMD | exonic | SEQ ID 1863 | NM_004006 | HS dystrophin (DMD), tvDp427m, mRNA. |
| DMD | exonic | SEQ ID 1864 | NM_004009 | HS dystrophin (DMD), tvDp427p1, mRNA. |
| CNTNAP5 | exonic | SEQ ID 1865 | NM_130773 | HS contactin associated protein-like 5 (CNTNAP5), mRNA. |
| OTUD5 | exonic | SEQ ID 1866 | NM_001136157 | HS OTU domain containing 5 (OTUD5), tv2, mRNA. |
| GRIPAP1 | exonic | SEQ ID 1867 | NM_020137 | HS GRIP1 associated protein 1 (GRIPAP1), tv1, mRNA. |
| OTUD5 | exonic | SEQ ID 1868 | NM_001136159 | HS OTU domain containing 5 (OTUD5), tv4, mRNA. |
| KCND1 | exonic | SEQ ID 1869 | NM_004979 | HS potassium voltage-gated channel, Shal-related subfamily, member 1 (KCND1), mRNA. |
| OTUD5 | exonic | SEQ ID 1870 | NM_017602 | HS OTU domain containing 5 (OTUD5), tv1, mRNA. |
| OTUD5 | exonic | SEQ ID 1871 | NM_001136158 | HS OTU domain containing 5 (OTUD5), tv3, mRNA. |
| ARHGAP15 | exonic | SEQ ID 1872 | NM_018460 | HS Rho GTPase activating protein 15 (ARHGAP15), mRNA. |
| IFT74 | exonic | SEQ ID 1873 | NM_001099223 | HS intraflagellar transport 74 homolog (*Chlamydomonas*) (IFT74), tv3, mRNA. |
| IFT74 | exonic | SEQ ID 1874 | NM_001099224 | HS intraflagellar transport 74 homolog (*Chlamydomonas*) (IFT74), tv4, mRNA. |
| IFT74 | exonic | SEQ ID 1875 | NM_025103 | HS intraflagellar transport 74 homolog (*Chlamydomonas*) (IFT74), tv1, mRNA. |
| IFT74 | exonic | SEQ ID 1876 | NM_001099222 | HS intraflagellar transport 74 homolog (*Chlamydomonas*) (IFT74), tv2, mRNA. |
| GTPBP10 | exonic | SEQ ID 1877 | NM_001042717 | HS GTP-binding protein 10 (putative) (GTPBP10), tv1, mRNA. |
| GTPBP10 | exonic | SEQ ID 1878 | NM_033107 | HS GTP-binding protein 10 (putative) (GTPBP10), tv2, mRNA. |
| UGT2A2 | exonic | SEQ ID 1879 | NM_001105677 | HS UDP glucuronosyltransferase 2 family, polypeptide A2 (UGT2A2), mRNA. |
| UGT2A1 | exonic | SEQ ID 1880 | NM_006798 | HS UDP glucuronosyltransferase 2 family, polypeptide A1, complex locus (UGT2A1), tv1, mRNA. |
| UGT2A1 | exonic | SEQ ID 1881 | NM_001252274 | HS UDP glucuronosyltransferase 2 family, polypeptide A1, complex locus (UGT2A1), tv2, mRNA. |
| UGT2A1 | exonic | SEQ ID 1882 | NM_001252275 | HS UDP glucuronosyltransferase 2 family, polypeptide A1, complex locus (UGT2A1), tv3, mRNA. |
| HCG9 | exonic | SEQ ID 1883 | NR_028032 | HS HLA complex group 9 (non-protein coding) (HCG9), non-coding RNA. |
| BTN2A1 | exonic | SEQ ID 1884 | NM_001197233 | HS butyrophilin, subfamily 2, member A1 (BTN2A1), tv3, mRNA. |
| BTN2A1 | exonic | SEQ ID 1885 | NM_001197234 | HS butyrophilin, subfamily 2, member A1 (BTN2A1), tv4, mRNA. |
| BTN3A3 | exonic | SEQ ID 1886 | NM_197974 | HS butyrophilin, subfamily 3, member A3 (BTN3A3), tv2, mRNA. |
| BTN2A1 | exonic | SEQ ID 1887 | NM_007049 | HS butyrophilin, subfamily 2, member A1 (BTN2A1), tv1, mRNA. |
| BTN3A3 | exonic | SEQ ID 1888 | NM_006994 | HS butyrophilin, subfamily 3, member A3 (BTN3A3), tv1, mRNA. |
| BTN3A3 | exonic | SEQ ID 1889 | NM_001242803 | HS butyrophilin, subfamily 3, member A3 (BTN3A3), tv3, mRNA. |
| BTN2A1 | exonic | SEQ ID 1890 | NM_078476 | HS butyrophilin, subfamily 2, member A1 (BTN2A1), tv2, mRNA. |
| APOL2 | exonic | SEQ ID 1891 | NM_030882 | HS apolipoprotein L, 2 (APOL2), tvalpha, mRNA. |
| APOL2 | exonic | SEQ ID 1892 | NM_145637 | HS apolipoprotein L, 2 (APOL2), tvbeta, mRNA. |
| TMLHE | exonic | SEQ ID 1893 | NM_018196 | HS trimethyllysine hydroxylase, epsilon (TMLHE), nuclear gene encoding mitochondrial protein, tv1, mRNA. |
| TMLHE | exonic | SEQ ID 1894 | NM_001184797 | HS trimethyllysine hydroxylase, epsilon (TMLHE), nuclear gene encoding mitochondrial protein, tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| BTN2A3P | exonic | SEQ ID 1895 | NR_027795 | HS butyrophilin, subfamily 2, member A3, pseudogene (BTN2A3P), non-coding RNA. |
| AKR1B10 | exonic | SEQ ID 1896 | NM_020299 | HS aldo-keto reductase family 1, member B10 (aldose reductase) (AKR1B10), mRNA. |
| LEP | exonic | SEQ ID 1897 | NM_000230 | HS leptin (LEP), mRNA. |
| RSU1P2 | exonic | SEQ ID 1898 | NR_024472 | HS Ras suppressor protein 1 pseudogene 2 (RSU1P2), non-coding RNA. |
| MGAM | exonic | SEQ ID 1899 | NM_004668 | HS maltase-glucoamylase (alpha-glucosidase) (MGAM), mRNA. |
| EHD3 | exonic | SEQ ID 1900 | NM_014600 | HS EH-domain containing 3 (EHD3), mRNA. |
| CAPN14 | exonic | SEQ ID 1901 | NM_001145122 | HS calpain 14 (CAPN14), mRNA. |
| ZNF618 | exonic | SEQ ID 1902 | NM_133374 | HS zinc finger protein 618 (ZNF618), mRNA. |
| AMBP | exonic | SEQ ID 1903 | NM_001633 | HS alpha-1-microglobulin/bikunin precursor (AMBP), mRNA. |
| KIF12 | exonic | SEQ ID 1904 | NM_138424 | HS kinesin family member 12 (KIF12), mRNA. |
| DAPP1 | exonic | SEQ ID 1905 | NM_014395 | HS dual adaptor of phosphotyrosine and 3-phosphoinositides (DAPP1), mRNA. |
| EFTUD1 | exonic | SEQ ID 1906 | NM_024580 | HS elongation factor Tu GTP binding domain containing 1 (EFTUD1), tv1, mRNA. |
| EFTUD1 | exonic | SEQ ID 1907 | NM_001040610 | HS elongation factor Tu GTP binding domain containing 1 (EFTUD1), tv2, mRNA. |
| FAM154B | exonic | SEQ ID 1908 | NM_001008226 | HS family with sequence similarity 154, member B (FAM154B), mRNA. |
| CAMKMT | exonic | SEQ ID 1909 | NM_024766 | HS calmodulin-lysine N-methyltransferase (CAMKMT), mRNA. |
| TSGA10 | exonic | SEQ ID 1910 | NM_182911 | HS testis specific, 10 (TSGA10), tv2, mRNA. |
| TSGA10 | exonic | SEQ ID 1911 | NM_025244 | HS testis specific, 10 (TSGA10), tv1, mRNA. |
| MITD1 | exonic | SEQ ID 1912 | NM_138798 | HS MIT, microtubule interacting and transport, domain containing 1 (MITD1), mRNA. |
| LIPT1 | exonic | SEQ ID 1913 | NM_145198 | HS lipoyltransferase 1 (LIPT1), nuclear gene encoding mitochondrial protein, tv4, mRNA. |
| LIPT1 | exonic | SEQ ID 1914 | NM_145197 | HS lipoyltransferase 1 (LIPT1), nuclear gene encoding mitochondrial protein, tv3, mRNA. |
| LIPT1 | exonic | SEQ ID 1915 | NM_145199 | HS lipoyltransferase 1 (LIPT1), nuclear gene encoding mitochondrial protein, tv5, mRNA. |
| LIPT1 | exonic | SEQ ID 1916 | NM_001204830 | HS lipoyltransferase 1 (LIPT1), nuclear gene encoding mitochondrial protein, tv6, mRNA. |
| MRPL30 | exonic | SEQ ID 1917 | NM_145212 | HS mitochondrial ribosomal protein L30 (MRPL30), nuclear gene encoding mitochondrial protein, tv1, mRNA. |
| LIPT1 | exonic | SEQ ID 1918 | NM_015929 | HS lipoyltransferase 1 (LIPT1), nuclear gene encoding mitochondrial protein, tv1, mRNA. |
| C2orf15 | exonic | SEQ ID 1919 | NM_144706 | HS chromosome 2 open reading frame 15 (C2orf15), mRNA. |
| MRPL30 | exonic | SEQ ID 1920 | NR_028356 | HS mitochondrial ribosomal protein L30 (MRPL30), tv3, non-coding RNA. |
| LIPT1 | exonic | SEQ ID 1921 | NR_037935 | HS lipoyltransferase 1 (LIPT1), tv7, non-coding RNA. |
| LIPT1 | exonic | SEQ ID 1922 | NR_037936 | HS lipoyltransferase 1 (LIPT1), tv2, non-coding RNA. |
| LINC00648 | exonic | SEQ ID 1923 | NR_039996 | HS long intergenic non-protein coding RNA 648 (LINC00648), non-coding RNA. |
| MIR548Y | exonic | SEQ ID 1924 | NR_037503 | HS microRNA 548y (MIR548Y), microRNA. |
| FBXO42 | exonic | SEQ ID 1925 | NM_018994 | HS F-box protein 42 (FBXO42), mRNA. |
| ANKRD33 | exonic | SEQ ID 1926 | NM_001130015 | HS ankyrin repeat domain 33 (ANKRD33), tv1, mRNA. |
| ANKRD33 | exonic | SEQ ID 1927 | NM_182608 | HS ankyrin repeat domain 33 (ANKRD33), tv2, mRNA. |
| NRXN3 | exonic | SEQ ID 1928 | NM_004796 | HS neurexin 3 (NRXN3), tv1, mRNA. |
| CASP8 | exonic | SEQ ID 1929 | NM_033355 | HS caspase 8, apoptosis-related cysteine peptidase (CASP8), tvB, mRNA. |
| CASP8 | exonic | SEQ ID 1930 | NM_001228 | HS caspase 8, apoptosis-related cysteine peptidase (CASP8), tvA, mRNA. |
| CASP8 | exonic | SEQ ID 1931 | NM_001080124 | HS caspase 8, apoptosis-related cysteine peptidase (CASP8), tvF, mRNA. |
| CASP8 | exonic | SEQ ID 1932 | NM_033358 | HS caspase 8, apoptosis-related cysteine peptidase (CASP8), tvE, mRNA. |
| MIR1322 | exonic | SEQ ID 1933 | NR_031711 | HS microRNA 1322 (MIR1322), microRNA. |
| PINX1 | exonic | SEQ ID 1934 | NM_017884 | HS PIN2/TERF1 interacting, telomerase inhibitor 1 (PINX1), mRNA. |
| F8A3 | exonic | SEQ ID 1935 | NM_001007524 | HS coagulation factor VIII-associated 3 (F8A3), mRNA. |
| F8A1 | exonic | SEQ ID 1936 | NM_012151 | HS coagulation factor VIII-associated 1 (F8A1), mRNA. |
| MIR1184-2 | exonic | SEQ ID 1937 | NR_036259 | HS microRNA 1184-2 (MIR1184-2), microRNA. |
| F8A2 | exonic | SEQ ID 1938 | NM_001007523 | HS coagulation factor VIII-associated 2 (F8A2), mRNA. |
| H2AFB1 | exonic | SEQ ID 1939 | NM_001017990 | HS H2A histone family, member B1 (H2AFB1), mRNA. |
| H2AFB3 | exonic | SEQ ID 1940 | NM_080720 | HS H2A histone family, member B3 (H2AFB3), mRNA. |
| MIR1184-1 | exonic | SEQ ID 1941 | NR_036049 | HS microRNA 1184-1 (MIR1184-1), microRNA. |
| H2AFB2 | exonic | SEQ ID 1942 | NM_001017991 | HS H2A histone family, member B2 (H2AFB2), mRNA. |
| TMLHE-AS1 | exonic | SEQ ID 1943 | NR_039991 | HS TMLHE antisense RNA 1 (TMLHE-AS1), non-coding RNA. |
| MIR1184-3 | exonic | SEQ ID 1944 | NR_036260 | HS microRNA 1184-3 (MIR1184-3), microRNA. |
| SYK | exonic | SEQ ID 1945 | NM_001174167 | HS spleen tyrosine kinase (SYK), tv3, mRNA. |
| LEPR | exonic | SEQ ID 1946 | NM_002303 | HS leptin receptor (LEPR), tv1, mRNA. |
| LEPR | exonic | SEQ ID 1947 | NM_001198689 | HS leptin receptor (LEPR), tv6, mRNA. |
| LEPR | exonic | SEQ ID 1948 | NM_001198687 | HS leptin receptor (LEPR), tv4, mRNA. |
| LEPR | exonic | SEQ ID 1949 | NM_001198688 | HS leptin receptor (LEPR), tv5, mRNA. |
| LEPR | exonic | SEQ ID 1950 | NM_001003679 | HS leptin receptor (LEPR), tv3, mRNA. |
| LEPR | exonic | SEQ ID 1951 | NM_001003680 | HS leptin receptor (LEPR), tv2, mRNA. |
| ASTN2 | exonic | SEQ ID 1952 | NM_198188 | HS astrotactin 2 (ASTN2), tv4, mRNA. |
| ASTN2 | exonic | SEQ ID 1953 | NM_001184734 | HS astrotactin 2 (ASTN2), tv5, mRNA. |
| ASTN2 | exonic | SEQ ID 1954 | NM_001184735 | HS astrotactin 2 (ASTN2), tv6, mRNA. |
| ASTN2 | exonic | SEQ ID 1955 | NM_014010 | HS astrotactin 2 (ASTN2), tv1, mRNA. |
| ASTN2 | exonic | SEQ ID 1956 | NM_198186 | HS astrotactin 2 (ASTN2), tv2, mRNA. |
| ASTN2 | exonic | SEQ ID 1957 | NM_198187 | HS astrotactin 2 (ASTN2), tv3, mRNA. |
| TRIM32 | exonic | SEQ ID 1958 | NM_012210 | HS tripartite motif containing 32 (TRIM32), tv1, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| TRIM32 | exonic | SEQ ID 1959 | NM_001099679 | HS tripartite motif containing 32 (TRIM32), tv2, mRNA. |
| LOC284801 | exonic | SEQ ID 1960 | NR_040095 | HS uncharacterized LOC284801 (LOC284801), non-coding RNA. |
| MIR663A | exonic | SEQ ID 1961 | NR_030386 | HS microRNA 663a (MIR663A), microRNA. |
| CDH13 | exonic | SEQ ID 1962 | NM_001257 | HS cadherin 13, H-cadherin (heart) (CDH13), tv1, mRNA. |
| CDH13 | exonic | SEQ ID 1963 | NM_001220490 | HS cadherin 13, H-cadherin (heart) (CDH13), tv4, mRNA. |
| CDH13 | exonic | SEQ ID 1964 | NM_001220489 | HS cadherin 13, H-cadherin (heart) (CDH13), tv3, mRNA. |
| CDH13 | exonic | SEQ ID 1965 | NM_001220488 | HS cadherin 13, H-cadherin (heart) (CDH13), tv2, mRNA. |
| CDH13 | exonic | SEQ ID 1966 | NM_001220492 | HS cadherin 13, H-cadherin (heart) (CDH13), tv6, mRNA. |
| CDH13 | exonic | SEQ ID 1967 | NM_001220491 | HS cadherin 13, H-cadherin (heart) (CDH13), tv5, mRNA. |
| ACAD10 | exonic | SEQ ID 1968 | NM_001136538 | HS acyl-CoA dehydrogenase family, member 10 (ACAD10), tv1, mRNA. |
| ACAD10 | exonic | SEQ ID 1969 | NM_025247 | HS acyl-CoA dehydrogenase family, member 10 (ACAD10), tv2, mRNA. |
| ALDH2 | exonic | SEQ ID 1970 | NM_001204889 | HS aldehyde dehydrogenase 2 family (mitochondrial) (ALDH2), nuclear gene encoding mitochondrial protein, tv2, mRNA. |
| ALDH2 | exonic | SEQ ID 1971 | NM_000690 | HS aldehyde dehydrogenase 2 family (mitochondrial) (ALDH2), nuclear gene encoding mitochondrial protein, tv1, mRNA. |
| MAPKAPK5-AS1 | exonic | SEQ ID 1972 | NR_015404 | HS MAPKAPK5 antisense RNA 1 (MAPKAPK5-AS1), non-coding RNA. |
| MAPKAPK5 | exonic | SEQ ID 1973 | NM_139078 | HS mitogen-activated protein kinase-activated protein kinase 5 (MAPKAPK5), tv2, mRNA. |
| MAPKAPK5 | exonic | SEQ ID 1974 | NM_003668 | HS mitogen-activated protein kinase-activated protein kinase 5 (MAPKAPK5), tv1, mRNA. |
| OR4A5 | exonic | SEQ ID 1975 | NM_001005272 | HS olfactory receptor, family 4, subfamily A, member 5 (OR4A5), mRNA. |
| PDCD2 | exonic | SEQ ID 1976 | NM_001199464 | HS programmed cell death 2 (PDCD2), tv6, mRNA. |
| PDCD2 | exonic | SEQ ID 1977 | NM_001199463 | HS programmed cell death 2 (PDCD2), tv5, mRNA. |
| PDCD2 | exonic | SEQ ID 1978 | NM_001199462 | HS programmed cell death 2 (PDCD2), tv4, mRNA. |
| TBP | exonic | SEQ ID 1979 | NM_001172085 | HS TATA box binding protein (TBP), tv2, mRNA. |
| TBP | exonic | SEQ ID 1980 | NM_003194 | HS TATA box binding protein (TBP), tv1, mRNA. |
| PDCD2 | exonic | SEQ ID 1981 | NM_002598 | HS programmed cell death 2 (PDCD2), tv1, mRNA. |
| PDCD2 | exonic | SEQ ID 1982 | NM_001199461 | HS programmed cell death 2 (PDCD2), tv3, mRNA. |
| PDCD2 | exonic | SEQ ID 1983 | NM_144781 | HS programmed cell death 2 (PDCD2), tv2, mRNA. |
| LOC100506060 | exonic | SEQ ID 1984 | NR_033959 | HS SMG1 homolog, phosphatidylinositol 3-kinase-related kinase (C. elegans) pseudogene (LOC100506060), non-coding RNA. |
| PDPR | exonic | SEQ ID 1985 | NM_017990 | HS pyruvate dehydrogenase phosphatase regulatory subunit (PDPR), mRNA. |
| CLEC18C | exonic | SEQ ID 1986 | NM_173619 | HS C-type lectin domain family 18, member C (CLEC18C), mRNA. |
| EXOSC6 | exonic | SEQ ID 1987 | NM_058219 | HS exosome component 6 (EXOSC6), mRNA. |
| AARS | exonic | SEQ ID 1988 | NM_001605 | HS alanyl-tRNA synthetase (AARS), mRNA. |
| CAMSAP2 | exonic | SEQ ID 1989 | NM_203459 | HS calmodulin regulated spectrin-associated protein family, member 2 (CAMSAP2), mRNA. |
| C1orf106 | exonic | SEQ ID 1990 | NM_018265 | HS chromosome 1 open reading frame 106 (C1orf106), tv1, mRNA. |
| C1orf106 | exonic | SEQ ID 1991 | NM_001142569 | HS chromosome 1 open reading frame 106 (C1orf106), tv2, mRNA. |
| GPR25 | exonic | SEQ ID 1992 | NM_005298 | HS G protein-coupled receptor 25 (GPR25), mRNA. |
| OR2L13 | exonic | SEQ ID 1993 | NM_175194 | HS olfactory receptor, family 2, subfamily L, member 13 (OR2L13), mRNA. |
| TRIM58 | exonic | SEQ ID 1994 | NM_015431 | HS tripartite motif containing 58 (TRIM58), mRNA. |
| OR14A16 | exonic | SEQ ID 1995 | NM_001001966 | HS olfactory receptor, family 14, subfamily A, member 16 (OR14A16), mRNA. |
| OR11L1 | exonic | SEQ ID 1996 | NM_001001959 | HS olfactory receptor, family 11, subfamily L, member 1 (OR11L1), mRNA. |
| OR2W3 | exonic | SEQ ID 1997 | NM_001001957 | HS olfactory receptor, family 2, subfamily W, member 3 (OR2W3), mRNA. |
| ZNF626 | exonic | SEQ ID 1998 | NM_145297 | HS zinc finger protein 626 (ZNF626), tv2, mRNA. |
| ZNF626 | exonic | SEQ ID 1999 | NM_001076675 | HS zinc finger protein 626 (ZNF626), tv1, mRNA. |
| FHIT | exonic | SEQ ID 2000 | NM_001166243 | HS fragile histidine triad (FHIT), tv2, mRNA. |
| FHIT | exonic | SEQ ID 2001 | NM_002012 | HS fragile histidine triad (FHIT), tv1, mRNA. |
| STEAP1 | exonic | SEQ ID 2002 | NM_012449 | HS six transmembrane epithelial antigen of the prostate 1 (STEAP1), mRNA. |
| STEAP2 | exonic | SEQ ID 2003 | NM_001040665 | HS STEAP family member 2, metalloreductase (STEAP2), tv2, mRNA. |
| STEAP2 | exonic | SEQ ID 2004 | NM_152999 | HS STEAP family member 2, metalloreductase (STEAP2), tv1, mRNA. |
| STEAP2 | exonic | SEQ ID 2005 | NM_001244946 | HS STEAP family member 2, metalloreductase (STEAP2), tv6, mRNA. |
| STEAP2 | exonic | SEQ ID 2006 | NM_001244944 | HS STEAP family member 2, metalloreductase (STEAP2), tv4, mRNA. |
| STEAP2 | exonic | SEQ ID 2007 | NM_001040666 | HS STEAP family member 2, metalloreductase (STEAP2), tv3, mRNA. |
| C7orf63 | exonic | SEQ ID 2008 | NM_001039706 | HS chromosome 7 open reading frame 63 (C7orf63), tv1, mRNA. |
| C7orf63 | exonic | SEQ ID 2009 | NM_001160138 | HS chromosome 7 open reading frame 63 (C7orf63), tv2, mRNA. |
| STEAP2 | exonic | SEQ ID 2010 | NM_001244945 | HS STEAP family member 2, metalloreductase (STEAP2), tv5, mRNA. |
| DEFA6 | exonic | SEQ ID 2011 | NM_001926 | HS defensin, alpha 6, Paneth cell-specific (DEFA6), mRNA. |
| DEFA10P | exonic | SEQ ID 2012 | NR_029386 | HS defensin, alpha 10 pseudogene (DEFA10P), non-coding RNA. |
| DEFB1 | exonic | SEQ ID 2013 | NM_005218 | HS defensin, beta 1 (DEFB1), mRNA. |
| DEFA4 | exonic | SEQ ID 2014 | NM_001925 | HS defensin, alpha 4, corticostatin (DEFA4), mRNA. |
| DEFA3 | exonic | SEQ ID 2015 | NM_005217 | HS defensin, alpha 3, neutrophil-specific (DEFA3), mRNA. |
| DEFA1B | exonic | SEQ ID 2016 | NM_001042500 | HS defensin, alpha 1B (DEFA1B), mRNA. |
| DEFA1 | exonic | SEQ ID 2017 | NM_004084 | HS defensin, alpha 1 (DEFA1), mRNA. |
| DEFT1P2 | exonic | SEQ ID 2018 | NR_036687 | HS defensin, theta 1 pseudogene 2 (DEFT1P2), non-coding RNA. |
| DEFT1P | exonic | SEQ ID 2019 | NR_036686 | HS defensin, theta 1 pseudogene (DEFT1P), non-coding RNA. |
| DEFA5 | exonic | SEQ ID 2020 | NM_021010 | HS defensin, alpha 5, Paneth cell-specific (DEFA5), mRNA. |
| RALGDS | exonic | SEQ ID 2021 | NM_001042368 | HS ral guanine nucleotide dissociation stimulator (RALGDS), tv2, mRNA. |
| ABO | exonic | SEQ ID 2022 | NM_020469 | HS ABO blood group (transferase A, alpha 1-3-N-acetylgalactosaminyltransferase; transferase B, alpha 1-3-galactosyltransferase) (ABO), mRNA. |
| GTF3C5 | exonic | SEQ ID 2023 | NM_012087 | HS general transcription factor IIIC, polypeptide 5, 63 kDa (GTF3C5), tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| GTF3C5 | exonic | SEQ ID 2024 | NM_001122823 | HS general transcription factor IIIC, polypeptide 5, 63 kDa (GTF3C5), tv1, mRNA. |
| RALGDS | exonic | SEQ ID 2025 | NM_006266 | HS ral guanine nucleotide dissociation stimulator (RALGDS), tv1, mRNA. |
| CELP | exonic | SEQ ID 2026 | NR_001275 | HS carboxyl ester lipase pseudogene (CELP), non-coding RNA. |
| GBGT1 | exonic | SEQ ID 2027 | NM_021996 | HS globoside alpha-1,3-N-acetylgalactosaminyltransferase 1 (GBGT1), mRNA. |
| OBP2B | exonic | SEQ ID 2028 | NM_014581 | HS odorant binding protein 2B (OBP2B), mRNA. |
| ZNF497 | exonic | SEQ ID 2029 | NM_198458 | HS zinc finger protein 497 (ZNF497), mRNA. |
| ZNF8 | exonic | SEQ ID 2030 | NM_021089 | HS zinc finger protein 8 (ZNF8), mRNA. |
| A1BG-AS1 | exonic | SEQ ID 2031 | NR_015380 | HS A1BG antisense RNA 1 (A1BG-AS1), non-coding RNA. |
| ZSCAN22 | exonic | SEQ ID 2032 | NM_181846 | HS zinc finger and SCAN domain containing 22 (ZSCAN22), mRNA. |
| A1BG | exonic | SEQ ID 2033 | NM_130786 | HS alpha-1-B glycoprotein (A1BG), mRNA. |
| ZNF497 | exonic | SEQ ID 2034 | NM_001207009 | HS zinc finger protein 497 (ZNF497), tv2, mRNA. |
| ZNF837 | exonic | SEQ ID 2035 | NM_138466 | HS zinc finger protein 837 (ZNF837), tv2, mRNA. |
| ZNF132 | exonic | SEQ ID 2036 | NM_003433 | HS zinc finger protein 132 (ZNF132), mRNA. |
| ZNF324 | exonic | SEQ ID 2037 | NM_014347 | HS zinc finger protein 324 (ZNF324), mRNA. |
| MIR4754 | exonic | SEQ ID 2038 | NR_039910 | HS microRNA 4754 (MIR4754), microRNA. |
| ZNF446 | exonic | SEQ ID 2039 | NM_017908 | HS zinc finger protein 446 (ZNF446), mRNA. |
| LOC646862 | exonic | SEQ ID 2040 | NM_001195135 | HS uncharacterized LOC646862 (LOC646862), mRNA. |
| RPS5 | exonic | SEQ ID 2041 | NM_001009 | HS ribosomal protein S5 (RPS5), mRNA. |
| ZNF584 | exonic | SEQ ID 2042 | NM_173548 | HS zinc finger protein 584 (ZNF584), mRNA. |
| ZNF837 | exonic | SEQ ID 2043 | NR_049780 | HS zinc finger protein 837 (ZNF837), tv1, non-coding RNA. |
| SLC27A5 | exonic | SEQ ID 2044 | NM_012254 | HS solute carrier family 27 (fatty acid transporter), member 5 (SLC27A5), mRNA. |
| ANKRD17 | exonic | SEQ ID 2045 | NM_198889 | HS ankyrin repeat domain 17 (ANKRD17), tv2, mRNA. |
| ANKRD17 | exonic | SEQ ID 2046 | NM_032217 | HS ankyrin repeat domain 17 (ANKRD17), tv1, mRNA. |
| COX18 | exonic | SEQ ID 2047 | NM_173827 | HS cytochrome c oxidase assembly homolog 18 (yeast) (COX18), nuclear gene encoding mitochondrial protein, mRNA. |
| C5orf42 | exonic | SEQ ID 2048 | NM_023073 | HS chromosome 5 open reading frame 42 (C5orf42), mRNA. |
| GLOD4 | exonic | SEQ ID 2049 | NM_016040 | HS glyoxalase domain containing 4 (GLOD4), mRNA. |
| FAM57A | exonic | SEQ ID 2050 | NM_024792 | HS family with sequence similarity 57, member A (FAM57A), mRNA. |
| GEMIN4 | exonic | SEQ ID 2051 | NM_015721 | HS gem (nuclear organelle) associated protein 4 (GEMIN4), mRNA. |
| DBIL5P | exonic | SEQ ID 2052 | NR_024120 | HS diazepam binding inhibitor-like 5, pseudogene (DBIL5P), non-coding RNA. |
| NFIA | exonic | SEQ ID 2053 | NM_001145512 | HS nuclear factor I/A (NFIA), tv4, mRNA. |
| NFIA | exonic | SEQ ID 2054 | NM_001145511 | HS nuclear factor I/A (NFIA), tv3, mRNA. |
| NFIA | exonic | SEQ ID 2055 | NM_001134673 | HS nuclear factor I/A (NFIA), tv1, mRNA. |
| NFIA | exonic | SEQ ID 2056 | NM_005595 | HS nuclear factor I/A (NFIA), tv2, mRNA. |
| GGPS1 | exonic | SEQ ID 2057 | NM_001037277 | HS geranylgeranyl diphosphate synthase 1 (GGPS1), tv2, mRNA. |
| ARID4B | exonic | SEQ ID 2058 | NM_016374 | HS AT rich interactive domain 4B (RBP1-like) (ARID4B), tv1, mRNA. |
| ARID4B | exonic | SEQ ID 2059 | NM_001206794 | HS AT rich interactive domain 4B (RBP1-like) (ARID4B), tv3, mRNA. |
| GGPS1 | exonic | SEQ ID 2060 | NR_036605 | HS geranylgeranyl diphosphate synthase 1 (GGPS1), tv3, non-coding RNA. |
| B3GALNT2 | exonic | SEQ ID 2061 | NM_152490 | HS beta-1,3-N-acetylgalactosaminyltransferase 2 (B3GALNT2), mRNA. |
| ARID4B | exonic | SEQ ID 2062 | NM_031371 | HS AT rich interactive domain 4B (RBP1-like) (ARID4B), tv2, mRNA. |
| NRXN3 | exonic | SEQ ID 2063 | NM_001105250 | HS neurexin 3 (NRXN3), tv3, mRNA. |
| NRXN3 | exonic | SEQ ID 2064 | NM_138970 | HS neurexin 3 (NRXN3), tv2, mRNA. |
| C6orf118 | exonic | SEQ ID 2065 | NM_144980 | HS chromosome 6 open reading frame 118 (C6orf118), mRNA. |
| AGPAT5 | exonic | SEQ ID 2066 | NM_018361 | HS 1-acylglycerol-3-phosphate O-acyltransferase 5 (lysophosphatidic acid acyltransferase, epsilon) (AGPAT5), mRNA. |
| LOC100652791 | exonic | SEQ ID 2067 | NR_045217 | HS uncharacterized LOC100652791 (LOC100652791), non-coding RNA. |
| XKR5 | exonic | SEQ ID 2068 | NM_207411 | HS XK, Kell blood group complex subunit-related family, member 5 (XKR5), mRNA. |
| MIR4659B | exonic | SEQ ID 2069 | NR_039807 | HS microRNA 4659b (MIR4659B), microRNA. |
| MIR4659A | exonic | SEQ ID 2070 | NR_039803 | HS microRNA 4659a (MIR4659A), microRNA. |
| SORBS2 | exonic | SEQ ID 2071 | NM_021069 | HS sorbin and SH3 domain containing 2 (SORBS2), tv2, mRNA. |
| SORBS2 | exonic | SEQ ID 2072 | NM_003603 | HS sorbin and SH3 domain containing 2 (SORBS2), tv1, mRNA. |
| SORBS2 | exonic | SEQ ID 2073 | NM_001145672 | HS sorbin and SH3 domain containing 2 (SORBS2), tv5, mRNA. |
| SORBS2 | exonic | SEQ ID 2074 | NM_001145671 | HS sorbin and SH3 domain containing 2 (SORBS2), tv4, mRNA. |
| SORBS2 | exonic | SEQ ID 2075 | NM_001145670 | HS sorbin and SH3 domain containing 2 (SORBS2), tv3, mRNA. |
| SORBS2 | exonic | SEQ ID 2076 | NM_001270771 | HS sorbin and SH3 domain containing 2 (SORBS2), tv9, mRNA. |
| SORBS2 | exonic | SEQ ID 2077 | NM_001145675 | HS sorbin and SH3 domain containing 2 (SORBS2), tv8, mRNA. |
| SORBS2 | exonic | SEQ ID 2078 | NM_001145674 | HS sorbin and SH3 domain containing 2 (SORBS2), tv7, mRNA. |
| SORBS2 | exonic | SEQ ID 2079 | NM_001145673 | HS sorbin and SH3 domain containing 2 (SORBS2), tv6, mRNA. |
| CHL1 | exonic | SEQ ID 2080 | NM_006614 | HS cell adhesion molecule with homology to L1CAM (close homolog of L1) (CHL1), tv1, mRNA. |
| CHL1 | exonic | SEQ ID 2081 | NR_045572 | HS cell adhesion molecule with homology to L1CAM (close homolog of L1) (CHL1), tv4, non-coding RNA. |
| CHL1 | exonic | SEQ ID 2082 | NM_001253388 | HS cell adhesion molecule with homology to L1CAM (close homolog of L1) (CHL1), tv3, mRNA. |
| CHL1 | exonic | SEQ ID 2083 | NM_001253387 | HS cell adhesion molecule with homology to L1CAM (close homolog of L1) (CHL1), tv2, mRNA. |
| PSG6 | exonic | SEQ ID 2084 | NM_002782 | HS pregnancy specific beta-1-glycoprotein 6 (PSG6), tv1, mRNA. |
| PSG6 | exonic | SEQ ID 2085 | NM_001031850 | HS pregnancy specific beta-1-glycoprotein 6 (PSG6), tv2, mRNA. |
| PSG8 | exonic | SEQ ID 2086 | NM_001130168 | HS pregnancy specific beta-1-glycoprotein 8 (PSG8), tv3, mRNA. |
| PSG8 | exonic | SEQ ID 2087 | NM_001130167 | HS pregnancy specific beta-1-glycoprotein 8 (PSG8), tv2, mRNA. |
| PSG8 | exonic | SEQ ID 2088 | NM_182707 | HS pregnancy specific beta-1-glycoprotein 8 (PSG8), tv1, mRNA. |
| PSG3 | exonic | SEQ ID 2089 | NM_021016 | HS pregnancy specific beta-1-glycoprotein 3 (PSG3), mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| PSG10P | exonic | SEQ ID 2090 | NR_026824 | HS pregnancy specific beta-1-glycoprotein 10, pseudogene (PSG10P), non-coding RNA. |
| PSG1 | exonic | SEQ ID 2091 | NM_006905 | HS pregnancy specific beta-1-glycoprotein 1 (PSG1), tv1, mRNA. |
| PSG1 | exonic | SEQ ID 2092 | NM_001184826 | HS pregnancy specific beta-1-glycoprotein 1 (PSG1), tv3, mRNA. |
| LOC100289650 | exonic | SEQ ID 2093 | NR_036584 | HS uncharacterized LOC100289650 (LOC100289650), non-coding RNA. |
| PSG1 | exonic | SEQ ID 2094 | NM_001184825 | HS pregnancy specific beta-1-glycoprotein 1 (PSG1), tv2, mRNA. |
| PSG11 | exonic | SEQ ID 2095 | NM_001113410 | HS pregnancy specific beta-1-glycoprotein 11 (PSG11), tv3, mRNA. |
| PSG7 | exonic | SEQ ID 2096 | NM_002783 | HS pregnancy specific beta-1-glycoprotein 7 (gene/pseudogene) (PSG7), tv1, mRNA. |
| PSG11 | exonic | SEQ ID 2097 | NM_002785 | HS pregnancy specific beta-1-glycoprotein 11 (PSG11), tv1, mRNA. |
| PSG11 | exonic | SEQ ID 2098 | NM_203287 | HS pregnancy specific beta-1-glycoprotein 11 (PSG11), tv2, mRNA. |
| PSG7 | exonic | SEQ ID 2099 | NM_001206650 | HS pregnancy specific beta-1-glycoprotein 7 (gene/pseudogene) (PSG7), tv2, mRNA. |
| PSG7 | exonic | SEQ ID 2100 | NR_073194 | HS pregnancy specific beta-1-glycoprotein 7 (gene/pseudogene) (PSG7), tv1, non-coding, non-coding RNA. |
| PSG2 | exonic | SEQ ID 2101 | NM_031246 | HS pregnancy specific beta-1-glycoprotein 2 (PSG2), mRNA. |
| DNAH5 | exonic | SEQ ID 2102 | NM_001369 | HS dynein, axonemal, heavy chain 5 (DNAH5), mRNA. |
| DCPS | exonic | SEQ ID 2103 | NM_014026 | HS decapping enzyme, scavenger (DCPS), mRNA. |
| TIRAP | exonic | SEQ ID 2104 | NM_148910 | HS toll-interleukin 1 receptor (TIR) domain containing adaptor protein (TIRAP), tv2, mRNA. |
| FOXRED1 | exonic | SEQ ID 2105 | NM_017547 | HS FAD-dependent oxidoreductase domain containing 1 (FOXRED1), nuclear gene encoding mitochondrial protein, tv1, mRNA. |
| FOXRED1 | exonic | SEQ ID 2106 | NR_037648 | HS FAD-dependent oxidoreductase domain containing 1 (FOXRED1), tv2, non-coding RNA. |
| FOXRED1 | exonic | SEQ ID 2107 | NR_037647 | HS FAD-dependent oxidoreductase domain containing 1 (FOXRED1), tv3, non-coding RNA. |
| FAM118B | exonic | SEQ ID 2108 | NM_024556 | HS family with sequence similarity 118, member B (FAM118B), mRNA. |
| TIRAP | exonic | SEQ ID 2109 | NM_001039661 | HS toll-interleukin 1 receptor (TIR) domain containing adaptor protein (TIRAP), tv3, mRNA. |
| SRPR | exonic | SEQ ID 2110 | NM_003139 | HS signal recognition particle receptor (docking protein) (SRPR), tv1, mRNA. |
| SRPR | exonic | SEQ ID 2111 | NM_001177842 | HS signal recognition particle receptor (docking protein) (SRPR), tv2, mRNA. |
| ST3GAL4 | exonic | SEQ ID 2112 | NM_001254758 | HS ST3 beta-galactoside alpha-2,3-sialyltransferase 4 (ST3GAL4), tv3, mRNA. |
| ST3GAL4 | exonic | SEQ ID 2113 | NM_001254757 | HS ST3 beta-galactoside alpha-2,3-sialyltransferase 4 (ST3GAL4), tv2, mRNA. |
| FLJ39051 | exonic | SEQ ID 2114 | NR_033839 | HS uncharacterized LOC399972 (FLJ39051), non-coding RNA. |
| ST3GAL4 | exonic | SEQ ID 2115 | NM_006278 | HS ST3 beta-galactoside alpha-2,3-sialyltransferase 4 (ST3GAL4), tv1, mRNA. |
| ST3GAL4 | exonic | SEQ ID 2116 | NM_001254759 | HS ST3 beta-galactoside alpha-2,3-sialyltransferase 4 (ST3GAL4), tv4, mRNA. |
| AKAP9 | exonic | SEQ ID 2117 | NM_147185 | HS A kinase (PRKA) anchor protein (yotiao) 9 (AKAP9), tv3, mRNA. |
| LRRD1 | exonic | SEQ ID 2118 | NM_001161528 | HS leucine-rich repeats and death domain containing 1 (LRRD1), mRNA. |
| AKAP9 | exonic | SEQ ID 2119 | NM_005751 | HS A kinase (PRKA) anchor protein (yotiao) 9 (AKAP9), tv2, mRNA. |
| MTERF | exonic | SEQ ID 2120 | NM_006980 | HS mitochondrial transcription termination factor (MTERF), nuclear gene encoding mitochondrial protein, mRNA. |
| ZFAND4 | exonic | SEQ ID 2121 | NM_001128324 | HS zinc finger, AN1-type domain 4 (ZFAND4), tv2, mRNA. |
| ZFAND4 | exonic | SEQ ID 2122 | NM_174890 | HS zinc finger, AN1-type domain 4 (ZFAND4), tv1, mRNA. |
| ALOX5 | exonic | SEQ ID 2123 | NM_000698 | HS arachidonate 5-lipoxygenase (ALOX5), tv1, mRNA. |
| MARCH8 | exonic | SEQ ID 2124 | NM_145021 | HS membrane-associated ring finger (C3HC4) 8, E3 ubiquitin protein ligase (MARCH8), tv2, mRNA. |
| ALOX5 | exonic | SEQ ID 2125 | NM_001256154 | HS arachidonate 5-lipoxygenase (ALOX5), tv3, mRNA. |
| ALOX5 | exonic | SEQ ID 2126 | NM_001256153 | HS arachidonate 5-lipoxygenase (ALOX5), tv2, mRNA. |
| MARCH8 | exonic | SEQ ID 2127 | NM_001002265 | HS membrane-associated ring finger (C3HC4) 8, E3 ubiquitin protein ligase (MARCH8), tv1, mRNA. |
| ANKRD30BP3 | ncRNA | SEQ ID 2128 | NR_033891 | HS ankyrin repeat domain 30B pseudogene 3 (ANKRD30BP3), non-coding RNA. |
| MIR3156-1 | exonic | SEQ ID 2129 | NR_036112 | HS microRNA 3156-1 (MIR3156-1), microRNA. |
| OR13A1 | exonic | SEQ ID 2130 | NM_001004297 | HS olfactory receptor, family 13, subfamily A, member 1 (OR13A1), mRNA. |
| MARCH8 | exonic | SEQ ID 2131 | NM_001002266 | HS membrane-associated ring finger (C3HC4) 8, E3 ubiquitin protein ligase (MARCH8), tv3, mRNA. |
| FBXO45 | exonic | SEQ ID 2132 | NM_001105573 | HS F-box protein 45 (FBXO45), mRNA. |
| CEP19 | exonic | SEQ ID 2133 | NM_032898 | HS centrosomal protein 19 kDa (CEP19), mRNA. |
| UBXN7 | exonic | SEQ ID 2134 | NM_015562 | HS UBX domain protein 7 (UBXN7), mRNA. |
| WDR53 | exonic | SEQ ID 2135 | NM_182627 | HS WD repeat domain 53 (WDR53), mRNA. |
| PAK2 | exonic | SEQ ID 2136 | NM_002577 | HS p21 protein (Cdc42/Rac)-activated kinase 2 (PAK2), mRNA. |
| PIGX | exonic | SEQ ID 2137 | NM_017861 | HS phosphatidylinositol glycan anchor biosynthesis, class X (PIGX), tv2, mRNA. |
| PIGX | exonic | SEQ ID 2138 | NM_001166304 | HS phosphatidylinositol glycan anchor biosynthesis, class X (PIGX), tv1, mRNA. |
| ZFP42 | exonic | SEQ ID 2139 | NM_174900 | HS ZFP42 zinc finger protein (ZFP42), mRNA. |
| TRIML2 | exonic | SEQ ID 2140 | NM_173553 | HS tripartite motif family-like 2 (TRIML2), mRNA. |
| AFF3 | exonic | SEQ ID 2141 | NM_002285 | HS AF4/FMR2 family, member 3 (AFF3), tv1, mRNA. |
| AFF3 | exonic | SEQ ID 2142 | NM_001025108 | HS AF4/FMR2 family, member 3 (AFF3), tv2, mRNA. |
| EIF5B | exonic | SEQ ID 2143 | NM_015904 | HS eukaryotic translation initiation factor 5B (EIF5B), mRNA. |
| LYG2 | exonic | SEQ ID 2144 | NM_175735 | HS lysozyme G-like 2 (LYG2), mRNA. |
| TXNDC9 | exonic | SEQ ID 2145 | NM_005783 | HS thioredoxin domain containing 9 (TXNDC9), mRNA. |
| LYG1 | exonic | SEQ ID 2146 | NM_174898 | HS lysozyme G-like 1 (LYG1), mRNA. |
| REV1 | exonic | SEQ ID 2147 | NM_016316 | HS REV1, polymerase (DNA directed) (REV1), tv1, mRNA. |
| REV1 | exonic | SEQ ID 2148 | NM_001037872 | HS REV1, polymerase (DNA directed) (REV1), tv2, mRNA. |
| UPP1 | exonic | SEQ ID 2149 | NM_003364 | HS uridine phosphorylase 1 (UPP1), tv1, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| PKD1L1 | exonic | SEQ ID 2150 | NM_138295 | HS polycystic kidney disease 1 like 1 (PKD1L1), mRNA. |
| HUS1 | exonic | SEQ ID 2151 | NR_037917 | HS HUS1 checkpoint homolog (S. pombe) (HUS1), tv2, non-coding RNA. |
| UPP1 | exonic | SEQ ID 2152 | NM_181597 | HS uridine phosphorylase 1 (UPP1), tv2, mRNA. |
| HUS1 | exonic | SEQ ID 2153 | NM_004507 | HS HUS1 checkpoint homolog (S. pombe) (HUS1), tv1, mRNA. |
| C7orf57 | exonic | SEQ ID 2154 | NM_001100159 | HS chromosome 7 open reading frame 57 (C7orf57), tv1, mRNA. |
| C7orf57 | exonic | SEQ ID 2155 | NM_001267866 | HS chromosome 7 open reading frame 57 (C7orf57), tv3, mRNA. |
| C7orf57 | exonic | SEQ ID 2156 | NM_001267865 | HS chromosome 7 open reading frame 57 (C7orf57), tv2, mRNA. |
| SUN3 | exonic | SEQ ID 2157 | NM_001030019 | HS Sad1 and UNC84 domain containing 3 (SUN3), tv1, mRNA. |
| SUN3 | exonic | SEQ ID 2158 | NM_152782 | HS Sad1 and UNC84 domain containing 3 (SUN3), tv2, mRNA. |
| CDC14C | exonic | SEQ ID 2159 | NR_003595 | HS cell division cycle 14C (CDC14C), non-coding RNA. |
| PTPN20B | exonic | SEQ ID 2160 | NM_015605 | HS protein tyrosine phosphatase, non-receptor type 20B (PTPN20B), tv2, mRNA. |
| PTPN20B | exonic | SEQ ID 2161 | NM_001042357 | HS protein tyrosine phosphatase, non-receptor type 20B (PTPN20B), tv1, mRNA. |
| PTPN20A | exonic | SEQ ID 2162 | NM_001042395 | HS protein tyrosine phosphatase, non-receptor type 20A (PTPN20A), tv8, mRNA. |
| PTPN20B | exonic | SEQ ID 2163 | NM_001042361 | HS protein tyrosine phosphatase, non-receptor type 20B (PTPN20B), tv6, mRNA. |
| PTPN20A | exonic | SEQ ID 2164 | NM_001042389 | HS protein tyrosine phosphatase, non-receptor type 20A (PTPN20A), tv1, mRNA. |
| PTPN20A | exonic | SEQ ID 2165 | NM_001042393 | HS protein tyrosine phosphatase, non-receptor type 20A (PTPN20A), tv6, mRNA. |
| PTPN20B | exonic | SEQ ID 2166 | NM_001042362 | HS protein tyrosine phosphatase, non-receptor type 20B (PTPN20B), tv7, mRNA. |
| PTPN20A | exonic | SEQ ID 2167 | NM_001042396 | HS protein tyrosine phosphatase, non-receptor type 20A (PTPN20A), tv9, mRNA. |
| PTPN20B | exonic | SEQ ID 2168 | NM_001042365 | HS protein tyrosine phosphatase, non-receptor type 20B (PTPN20B), tv10, mRNA. |
| PTPN20B | exonic | SEQ ID 2169 | NM_001042358 | HS protein tyrosine phosphatase, non-receptor type 20B (PTPN20B), tv3, mRNA. |
| PTPN20A | exonic | SEQ ID 2170 | NM_001042387 | HS protein tyrosine phosphatase, non-receptor type 20A (PTPN20A), tv2, mRNA. |
| PTPN20B | exonic | SEQ ID 2171 | NM_001042360 | HS protein tyrosine phosphatase, non-receptor type 20B (PTPN20B), tv5, mRNA. |
| PTPN20A | exonic | SEQ ID 2172 | NM_001042391 | HS protein tyrosine phosphatase, non-receptor type 20A (PTPN20A), tv4, mRNA. |
| PTPN20A | exonic | SEQ ID 2173 | NM_001042390 | HS protein tyrosine phosphatase, non-receptor type 20A (PTPN20A), tv3, mRNA. |
| PTPN20A | exonic | SEQ ID 2174 | NM_001042394 | HS protein tyrosine phosphatase, non-receptor type 20A (PTPN20A), tv7, mRNA. |
| PTPN20A | exonic | SEQ ID 2175 | NM_001042397 | HS protein tyrosine phosphatase, non-receptor type 20A (PTPN20A), tv10, mRNA. |
| PTPN20B | exonic | SEQ ID 2176 | NM_001042359 | HS protein tyrosine phosphatase, non-receptor type 20B (PTPN20B), tv4, mRNA. |
| PTPN20A | exonic | SEQ ID 2177 | NM_001042392 | HS protein tyrosine phosphatase, non-receptor type 20A (PTPN20A), tv5, mRNA. |
| PTPN20B | exonic | SEQ ID 2178 | NM_001042363 | HS protein tyrosine phosphatase, non-receptor type 20B (PTPN20B), tv8, mRNA. |
| PTPN20B | exonic | SEQ ID 2179 | NM_001042364 | HS protein tyrosine phosphatase, non-receptor type 20B (PTPN20B), tv9, mRNA. |
| LINC00842 | ncRNA | SEQ ID 2180 | NR_033957 | HS long intergenic non-protein coding RNA 842 (LINC00842), non-coding RNA. |
| FAM21C | exonic | SEQ ID 2181 | NM_001169106 | HS family with sequence similarity 21, member C (FAM21C), tv2, mRNA. |
| FAM21C | exonic | SEQ ID 2182 | NM_001169107 | HS family with sequence similarity 21, member C (FAM21C), tv3, mRNA. |
| FAM21C | exonic | SEQ ID 2183 | NM_015262 | HS family with sequence similarity 21, member C (FAM21C), tv1, mRNA. |
| AGAP4 | exonic | SEQ ID 2184 | NM_133446 | HS ArfGAP with GTPase domain, ankyrin repeat and PH domain 4 (AGAP4), mRNA. |
| FRMPD2P1 | exonic | SEQ ID 2185 | NR_033172 | HS FERM and PDZ domain containing 2 pseudogene 1 (FRMPD2P1), non-coding RNA. |
| BMS1P1 | exonic | SEQ ID 2186 | NR_026566 | HS BMS1 pseudogene 1 (BMS1P1), non-coding RNA. |
| BMS1P5 | exonic | SEQ ID 2187 | NR_003611 | HS BMS1 pseudogene 5 (BMS1P5), non-coding RNA. |
| GLUD1P7 | exonic | SEQ ID 2188 | NR_048574 | HS glutamate dehydrogenase 1 pseudogene 7 (GLUD1P7), non-coding RNA. |
| SYT15 | exonic | SEQ ID 2189 | NM_031974 | HS synaptotagmin XV (SYT15), tva, mRNA. |
| FAM35BP | ncRNA | SEQ ID 2190 | NR_027632 | HS family with sequence similarity 35, member B, pseudogene (FAM35BP), non-coding RNA. |
| SYT15 | exonic | SEQ ID 2191 | NM_181519 | HS synaptotagmin XV (SYT15), tvb, mRNA. |
| GPRIN2 | exonic | SEQ ID 2192 | NM_014696 | HS G protein regulated inducer of neurite outgrowth 2 (GPRIN2), mRNA. |
| PPYR1 | exonic | SEQ ID 2193 | NM_005972 | HS pancreatic polypeptide receptor 1 (PPYR1), mRNA. |
| HNRNPA1P33 | ncRNA | SEQ ID 2194 | NR_003277 | HS heterogeneous nuclear ribonucleoprotein A1 pseudogene 33 (HNRNPA1P33), non-coding RNA. |
| DPYD-AS1 | exonic | SEQ ID 2195 | NR_046590 | HS DPYD antisense RNA 1 (DPYD-AS1), non-coding RNA. |
| DPYD | exonic | SEQ ID 2196 | NM_001160301 | HS dihydropyrimidine dehydrogenase (DPYD), tv2, mRNA. |
| MIR2682 | exonic | SEQ ID 2197 | NR_039604 | HS microRNA 2682 (MIR2682), microRNA. |
| MIR137 | exonic | SEQ ID 2198 | NR_029679 | HS microRNA 137 (MIR137), microRNA. |
| MIR137HG | exonic | SEQ ID 2199 | NR_046105 | HS MIR137 host gene (non-protein coding) (MIR137HG), non-coding RNA. |
| CNTN6 | exonic | SEQ ID 2200 | NM_014461 | HS contactin 6 (CNTN6), mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| FAM189A1 | exonic | SEQ ID 2201 | NM_015307 | HS family with sequence similarity 189, member A1 (FAM189A1), mRNA. |
| APBA2 | exonic | SEQ ID 2202 | NM_001130414 | HS amyloid beta (A4) precursor protein-binding, family A, member 2 (APBA2), tv2, mRNA. |
| APBA2 | exonic | SEQ ID 2203 | NM_005503 | HS amyloid beta (A4) precursor protein-binding, family A, member 2 (APBA2), tv1, mRNA. |
| LOC646278 | exonic | SEQ ID 2204 | NR_037599 | HS programmed cell death 6 interacting protein pseudogene (LOC646278), non-coding RNA. |
| TJP1 | exonic | SEQ ID 2205 | NM_175610 | HS tight junction protein 1 (TJP1), tv2, mRNA. |
| TJP1 | exonic | SEQ ID 2206 | NM_003257 | HS tight junction protein 1 (TJP1), tv1, mRNA. |
| LOC100289656 | exonic | SEQ ID 2207 | NR_036475 | HS Dexi homolog (mouse) pseudogene (LOC100289656), non-coding RNA. |
| GOLGA6L7P | exonic | SEQ ID 2208 | NR_047567 | HS golgin A6 family-like 7, pseudogene (GOLGA6L7P), non-coding RNA. |
| NDNL2 | exonic | SEQ ID 2209 | NM_138704 | HS necdin-like 2 (NDNL2), mRNA. |
| MPHOSPH6 | exonic | SEQ ID 2210 | NM_005792 | HS M-phase phosphoprotein 6 (MPHOSPH6), mRNA. |
| MIR3182 | exonic | SEQ ID 2211 | NR_036147 | HS microRNA 3182 (MIR3182), microRNA. |
| BMS1P6 | exonic | SEQ ID 2212 | NR_024495 | HS BMS1 pseudogene 6 (BMS1P6), non-coding RNA. |
| BMS1P2 | exonic | SEQ ID 2213 | NR_072978 | HS BMS1 pseudogene 2 (BMS1P2), non-coding RNA. |
| FAM25C | exonic | SEQ ID 2214 | NM_001137548 | HS family with sequence similarity 25, member C (FAM25C), mRNA. |
| AGAP9 | exonic | SEQ ID 2215 | NM_001190810 | HS ArfGAP with GTPase domain, ankyrin repeat and PH domain 9 (AGAP9), mRNA. |
| FAM25G | exonic | SEQ ID 2216 | NM_001137549 | HS family with sequence similarity 25, member G (FAM25G), mRNA. |
| FAM25B | exonic | SEQ ID 2217 | NM_001137556 | HS family with sequence similarity 25, member B (FAM25B), mRNA. |
| ANXA8 | exonic | SEQ ID 2218 | NM_001040084 | HS annexin A8 (ANXA8), tv2, mRNA. |
| ANXA8L1 | exonic | SEQ ID 2219 | NM_001098845 | HS annexin A8-like 1 (ANXA8L1), mRNA. |
| FAM35DP | ncRNA | SEQ ID 2220 | NR_027634 | HS family with sequence similarity 35, member D, pseudogene (FAM35DP), non-coding RNA. |
| DKFZP434L187 | exonic | SEQ ID 2221 | NR_026771 | HS uncharacterized LOC26082 (DKFZP434L187), non-coding RNA. |
| ULK4P3 | exonic | SEQ ID 2222 | NR_026859 | HS unc-51-like kinase 4 (C. elegans) pseudogene 3 (ULK4P3), non-coding RNA. |
| ULK4P1 | exonic | SEQ ID 2223 | NR_026858 | HS unc-51-like kinase 4 (C. elegans) pseudogene 1 (ULK4P1), non-coding RNA. |
| ULK4P2 | exonic | SEQ ID 2224 | NR_027470 | HS unc-51-like kinase 4 (C. elegans) pseudogene 2 (ULK4P2), non-coding RNA. |
| GOLGA8T | exonic | SEQ ID 2225 | NR_033933 | HS golgin A8 family, member T (GOLGA8T), non-coding RNA. |
| EFCAB2 | exonic | SEQ ID 2226 | NR_026588 | HS EF-hand calcium binding domain 2 (EFCAB2), tv5, non-coding RNA. |
| EFCAB2 | exonic | SEQ ID 2227 | NM_032328 | HS EF-hand calcium binding domain 2 (EFCAB2), tv1, mRNA. |
| EFCAB2 | exonic | SEQ ID 2228 | NM_001143943 | HS EF-hand calcium binding domain 2 (EFCAB2), tv2, mRNA. |
| EFCAB2 | exonic | SEQ ID 2229 | NR_026587 | HS EF-hand calcium binding domain 2 (EFCAB2), tv4, non-coding RNA. |
| EFCAB2 | exonic | SEQ ID 2230 | NR_026586 | HS EF-hand calcium binding domain 2 (EFCAB2), tv3, non-coding RNA. |
| SMYD3 | exonic | SEQ ID 2231 | NM_022743 | HS SET and MYND domain containing 3 (SMYD3), tv2, mRNA. |
| SMYD3 | exonic | SEQ ID 2232 | NM_001167740 | HS SET and MYND domain containing 3 (SMYD3), tv1, mRNA. |
| CNST | exonic | SEQ ID 2233 | NM_001139459 | HS consortin, connexin sorting protein (CNST), tv2, mRNA. |
| CNST | exonic | SEQ ID 2234 | NM_152609 | HS consortin, connexin sorting protein (CNST), tv1, mRNA. |
| HNRNPU-AS1 | exonic | SEQ ID 2235 | NR_026778 | HS HNRNPU antisense RNA 1 (HNRNPU-AS1), non-coding RNA. |
| HNRNPU | exonic | SEQ ID 2236 | NM_031844 | HS heterogeneous nuclear ribonucleoprotein U (scaffold attachment factor A) (HNRNPU), tv1, mRNA. |
| HNRNPU | exonic | SEQ ID 2237 | NM_004501 | HS heterogeneous nuclear ribonucleoprotein U (scaffold attachment factor A) (HNRNPU), tv2, mRNA. |
| COX20 | exonic | SEQ ID 2238 | NM_198076 | HS COX20 Cox2 chaperone homolog (S. cerevisiae) (COX20), mRNA. |
| TFB2M | exonic | SEQ ID 2239 | NM_022366 | HS transcription factor B2, mitochondrial (TFB2M), nuclear gene encoding mitochondrial protein, mRNA. |
| LOC255654 | exonic | SEQ ID 2240 | NR_040002 | HS uncharacterized LOC255654 (LOC255654), non-coding RNA. |
| LOC339975 | exonic | SEQ ID 2241 | NR_038931 | HS uncharacterized LOC339975 (LOC339975), non-coding RNA. |
| LOC401164 | exonic | SEQ ID 2242 | NR_033869 | HS uncharacterized LOC401164 (LOC401164), non-coding RNA. |
| TRIML1 | exonic | SEQ ID 2243 | NM_178556 | HS tripartite motif family-like 1 (TRIML1), mRNA. |
| FRG1B | exonic | SEQ ID 2244 | NR_003579 | HS FSHD region gene 1 family, member B (FRG1B), non-coding RNA. |
| MLLT10P1 | exonic | SEQ ID 2245 | NR_045115 | HS myeloid/lymphoid or mixed-lineage leukemia (trithorax homolog, Drosophila); translocated to, 10 pseudogene 1 (MLLT10P1), non-coding RNA. |
| OR4C46 | exonic | SEQ ID 2246 | NM_001004703 | HS olfactory receptor, family 4, subfamily C, member 46 (OR4C46), mRNA. |
| GAGE2A | exonic | SEQ ID 2247 | NM_001127212 | HS G antigen 2A (GAGE2A), mRNA. |
| PPP1R3F | exonic | SEQ ID 2248 | NM_001184745 | HS protein phosphatase 1, regulatory subunit 3F (PPP1R3F), tv2, mRNA. |
| GAGE2E | exonic | SEQ ID 2249 | NM_001127200 | HS G antigen 2E (GAGE2E), mRNA. |
| GAGE8 | exonic | SEQ ID 2250 | NM_012196 | HS G antigen 8 (GAGE8), mRNA. |
| GAGE2C | exonic | SEQ ID 2251 | NM_001472 | HS G antigen 2C (GAGE2C), mRNA. |
| PPP1R3F | exonic | SEQ ID 2252 | NM_033215 | HS protein phosphatase 1, regulatory subunit 3F (PPP1R3F), tv1, mRNA. |
| CLCN5 | exonic | SEQ ID 2253 | NM_001127899 | HS chloride channel, voltage-sensitive 5 (CLCN5), tv1, mRNA. |
| CLCN5 | exonic | SEQ ID 2254 | NM_001127898 | HS chloride channel, voltage-sensitive 5 (CLCN5), tv2, mRNA. |
| CCNB3 | exonic | SEQ ID 2255 | NM_033670 | HS cyclin B3 (CCNB3), tv1, mRNA. |
| CCNB3 | exonic | SEQ ID 2256 | NM_033031 | HS cyclin B3 (CCNB3), tv3, mRNA. |
| DGKK | exonic | SEQ ID 2257 | NM_001013742 | HS diacylglycerol kinase, kappa (DGKK), mRNA. |
| SHROOM4 | exonic | SEQ ID 2258 | NM_020717 | HS shroom family member 4 (SHROOM4), tv1, mRNA. |
| SHROOM4 | exonic | SEQ ID 2259 | NR_027121 | HS shroom family member 4 (SHROOM4), tv2, non-coding RNA. |
| MAGED1 | exonic | SEQ ID 2260 | NM_001005332 | HS melanoma antigen family D, 1 (MAGED1), tv3, mRNA. |
| XAGE1E | exonic | SEQ ID 2261 | NR_033257 | HS X antigen family, member 1E (XAGE1E), tvc, non-coding RNA. |
| XAGE1D | exonic | SEQ ID 2262 | NR_033256 | HS X antigen family, member 1D (XAGE1D), tvc, non-coding RNA. |
| XAGE1B | exonic | SEQ ID 2263 | NR_033254 | HS X antigen family, member 1B (XAGE1B), tvc, non-coding RNA. |
| XAGE1B | exonic | SEQ ID 2264 | NM_001097594 | HS X antigen family, member 1B (XAGE1B), tva, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| XAGE1A | exonic | SEQ ID 2265 | NM_001097593 | HS X antigen family, member 1A (XAGE1A), tvd, mRNA. |
| XAGE1B | exonic | SEQ ID 2266 | NM_001097596 | HS X antigen family, member 1B (XAGE1B), tvd, mRNA. |
| XAGE1D | exonic | SEQ ID 2267 | NM_133430 | HS X antigen family, member 1D (XAGE1D), tvd, mRNA. |
| XAGE1C | exonic | SEQ ID 2268 | NM_001097597 | HS X antigen family, member 1C (XAGE1C), tva, mRNA. |
| XAGE1E | exonic | SEQ ID 2269 | NM_001097604 | HS X antigen family, member 1E (XAGE1E), tva, mRNA. |
| XAGE1C | exonic | SEQ ID 2270 | NR_033251 | HS X antigen family, member 1C (XAGE1C), tvc, non-coding RNA. |
| XAGE1E | exonic | SEQ ID 2271 | NM_001097605 | HS X antigen family, member 1E (XAGE1E), tvd, mRNA. |
| XAGE1D | exonic | SEQ ID 2272 | NM_020411 | HS X antigen family, member 1D (XAGE1D), tva, mRNA. |
| XAGE1A | exonic | SEQ ID 2273 | NR_033253 | HS X antigen family, member 1A (XAGE1A), tvc, non-coding RNA. |
| XAGE1C | exonic | SEQ ID 2274 | NM_001097598 | HS X antigen family, member 1C (XAGE1C), tvd, mRNA. |
| SSX7 | exonic | SEQ ID 2275 | NM_173358 | HS synovial sarcoma, X breakpoint 7 (SSX7), mRNA. |
| XAGE1A | exonic | SEQ ID 2276 | NM_001097592 | HS X antigen family, member 1A (XAGE1A), tva, mRNA. |
| FTSJ1 | exonic | SEQ ID 2277 | NM_177439 | HS FtsJ RNA methyltransferase homolog 1 (*E. coli*) (FTSJ1), tv3, mRNA. |
| FTSJ1 | exonic | SEQ ID 2278 | NM_177434 | HS FtsJ RNA methyltransferase homolog 1 (*E. coli*) (FTSJ1), tv2, mRNA. |
| FTSJ1 | exonic | SEQ ID 2279 | NM_012280 | HS FtsJ RNA methyltransferase homolog 1 (*E. coli*) (FTSJ1), tv1, mRNA. |
| SLC38A5 | exonic | SEQ ID 2280 | NM_033518 | HS solute carrier family 38, member 5 (SLC38A5), mRNA. |
| RBM3 | exonic | SEQ ID 2281 | NM_006743 | HS RNA binding motif (RNP1, RRM) protein 3 (RBM3), mRNA. |
| WDR13 | exonic | SEQ ID 2282 | NM_001166426 | HS WD repeat domain 13 (WDR13), tv2, mRNA. |
| WDR13 | exonic | SEQ ID 2283 | NM_017883 | HS WD repeat domain 13 (WDR13), tv1, mRNA. |
| EBP | exonic | SEQ ID 2284 | NM_006579 | HS emopamil binding protein (sterol isomerase) (EBP), mRNA. |
| TBC1D25 | exonic | SEQ ID 2285 | NM_002536 | HS TBC1 domain family, member 25 (TBC1D25), mRNA. |
| PORCN | exonic | SEQ ID 2286 | NM_022825 | HS porcupine homolog (*Drosophila*) (PORCN), tvA, mRNA. |
| WDR13 | exonic | SEQ ID 2287 | NR_029427 | HS WD repeat domain 13 (WDR13), tv3, non-coding RNA. |
| PORCN | exonic | SEQ ID 2288 | NM_203475 | HS porcupine homolog (*Drosophila*) (PORCN), tvD, mRNA. |
| PORCN | exonic | SEQ ID 2289 | NM_203474 | HS porcupine homolog (*Drosophila*) (PORCN), tvC, mRNA. |
| PORCN | exonic | SEQ ID 2290 | NM_203473 | HS porcupine homolog (*Drosophila*) (PORCN), tvB, mRNA. |
| SUV39H1 | exonic | SEQ ID 2291 | NM_003173 | HS suppressor of variegation 3-9 homolog 1 (*Drosophila*) (SUV39H1), mRNA. |
| WAS | exonic | SEQ ID 2292 | NM_000377 | HS Wiskott-Aldrich syndrome (WAS), mRNA. |
| GATA1 | exonic | SEQ ID 2293 | NM_002049 | HS GATA binding protein 1 (globin transcription factor 1) (GATA1), mRNA. |
| GLOD5 | exonic | SEQ ID 2294 | NM_001080489 | HS glyoxalase domain containing 5 (GLOD5), mRNA. |
| PCSK1N | exonic | SEQ ID 2295 | NM_013271 | HS proprotein convertase subtilisin/kexin type 1 inhibitor (PCSK1N), mRNA. |
| HDAC6 | exonic | SEQ ID 2296 | NM_006044 | HS histone deacetylase 6 (HDAC6), mRNA. |
| ERAS | exonic | SEQ ID 2297 | NM_181532 | HS ES cell expressed Ras (ERAS), mRNA. |
| PQBP1 | exonic | SEQ ID 2298 | NM_005710 | HS polyglutamine binding protein 1 (PQBP1), tv1, mRNA. |
| PQBP1 | exonic | SEQ ID 2299 | NM_001032384 | HS polyglutamine binding protein 1 (PQBP1), tv5, mRNA. |
| PQBP1 | exonic | SEQ ID 2300 | NM_001032383 | HS polyglutamine binding protein 1 (PQBP1), tv4, mRNA. |
| SLC35A2 | exonic | SEQ ID 2301 | NM_001042498 | HS solute carrier family 35 (UDP-galactose transporter), member A2 (SLC35A2), tv3, mRNA. |
| PQBP1 | exonic | SEQ ID 2302 | NM_144495 | HS polyglutamine binding protein 1 (PQBP1), tv7, mRNA. |
| PIM2 | exonic | SEQ ID 2303 | NM_006875 | HS pim-2 oncogene (PIM2), mRNA. |
| PQBP1 | exonic | SEQ ID 2304 | NM_001032382 | HS polyglutamine binding protein 1 (PQBP1), tv3, mRNA. |
| PQBP1 | exonic | SEQ ID 2305 | NM_001032381 | HS polyglutamine binding protein 1 (PQBP1), tv2, mRNA. |
| PQBP1 | exonic | SEQ ID 2306 | NM_001167992 | HS polyglutamine binding protein 1 (PQBP1), tv10, mRNA. |
| PQBP1 | exonic | SEQ ID 2307 | NM_001167989 | HS polyglutamine binding protein 1 (PQBP1), tv8, mRNA. |
| PQBP1 | exonic | SEQ ID 2308 | NM_001167990 | HS polyglutamine binding protein 1 (PQBP1), tv9, mRNA. |
| TIMM17B | exonic | SEQ ID 2309 | NM_001167947 | HS translocase of inner mitochondrial membrane 17 homolog B (yeast) (TIMM17B), nuclear gene encoding mitochondrial protein, tv1, mRNA. |
| TIMM17B | exonic | SEQ ID 2310 | NM_005834 | HS translocase of inner mitochondrial membrane 17 homolog B (yeast) (TIMM17B), nuclear gene encoding mitochondrial protein, tv2, mRNA. |
| SLC35A2 | exonic | SEQ ID 2311 | NM_005660 | HS solute carrier family 35 (UDP-galactose transporter), member A2 (SLC35A2), tv1, mRNA. |
| GRIPAP1 | exonic | SEQ ID 2312 | NM_207672 | HS GRIP1 associated protein 1 (GRIPAP1), tv2, mRNA. |
| SLC35A2 | exonic | SEQ ID 2313 | NM_001032289 | HS solute carrier family 35 (UDP-galactose transporter), member A2 (SLC35A2), tv2, mRNA. |
| PRAF2 | exonic | SEQ ID 2314 | NM_007213 | HS PRAT domain family, member 2 (PRAF2), mRNA. |
| GPKOW | exonic | SEQ ID 2315 | NM_015698 | HS G patch domain and KOW motifs (GPKOW), mRNA. |
| CCDC120 | exonic | SEQ ID 2316 | NM_001163323 | HS coiled-coil domain containing 120 (CCDC120), tv4, mRNA. |
| CCDC120 | exonic | SEQ ID 2317 | NM_001163322 | HS coiled-coil domain containing 120 (CCDC120), tv2, mRNA. |
| CCDC120 | exonic | SEQ ID 2318 | NM_033626 | HS coiled-coil domain containing 120 (CCDC120), tv3, mRNA. |
| WDR45 | exonic | SEQ ID 2319 | NM_007075 | HS WD repeat domain 45 (WDR45), tv1, mRNA. |
| WDR45 | exonic | SEQ ID 2320 | NM_001029896 | HS WD repeat domain 45 (WDR45), tv2, mRNA. |
| TFE3 | exonic | SEQ ID 2321 | NM_006521 | HS transcription factor binding to IGHM enhancer 3 (TFE3), mRNA. |
| CCDC120 | exonic | SEQ ID 2322 | NM_001163321 | HS coiled-coil domain containing 120 (CCDC120), tv1, mRNA. |
| PLP2 | exonic | SEQ ID 2323 | NM_002664 | HS proteolipid protein 2 (colonic epithelium-enriched) (PLP2), mRNA. |
| PRICKLE3 | exonic | SEQ ID 2324 | NM_006150 | HS prickle homolog 3 (*Drosophila*) (PRICKLE3), mRNA. |
| SYP | exonic | SEQ ID 2325 | NM_003179 | HS synaptophysin (SYP), mRNA. |
| MAGIX | exonic | SEQ ID 2326 | NM_001099682 | HS MAGI family member, X-linked (MAGIX), tv4, mRNA. |
| MAGIX | exonic | SEQ ID 2327 | NM_001099681 | HS MAGI family member, X-linked (MAGIX), tv3, mRNA. |
| CCDC22 | exonic | SEQ ID 2328 | NM_014008 | HS coiled-coil domain containing 22 (CCDC22), mRNA. |
| FOXP3 | exonic | SEQ ID 2329 | NM_014009 | HS forkhead box P3 (FOXP3), tv1, mRNA. |
| FOXP3 | exonic | SEQ ID 2330 | NM_001114377 | HS forkhead box P3 (FOXP3), tv2, mRNA. |
| CACNA1F | exonic | SEQ ID 2331 | NM_005183 | HS calcium channel, voltage-dependent, L type, alpha 1F subunit (CACNA1F), tv1, mRNA. |
| MAGIX | exonic | SEQ ID 2332 | NM_024859 | HS MAGI family member, X-linked (MAGIX), tv1, mRNA. |
| MAGIX | exonic | SEQ ID 2333 | NM_001099680 | HS MAGI family member, X-linked (MAGIX), tv2, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| CACNA1F | exonic | SEQ ID 2334 | NM_001256789 | HS calcium channel, voltage-dependent, L type, alpha 1F subunit (CACNA1F), tv2, mRNA. |
| CACNA1F | exonic | SEQ ID 2335 | NM_001256790 | HS calcium channel, voltage-dependent, L type, alpha 1F subunit (CACNA1F), tv3, mRNA. |
| GAGE10 | exonic | SEQ ID 2336 | NM_001098413 | HS G antigen 10 (GAGE10), mRNA. |
| GAGE12J | exonic | SEQ ID 2337 | NM_001098406 | HS G antigen 12J (GAGE12J), mRNA. |
| GAGE12F | exonic | SEQ ID 2338 | NM_001098405 | HS G antigen 12F (GAGE12F), mRNA. |
| GAGE2D | exonic | SEQ ID 2339 | NM_001098407 | HS G antigen 2D (GAGE2D), mRNA. |
| GAGE5 | exonic | SEQ ID 2340 | NM_001475 | HS G antigen 5 (GAGE5), mRNA. |
| GAGE13 | exonic | SEQ ID 2341 | NM_001098412 | HS G antigen 13 (GAGE13), mRNA. |
| GAGE4 | exonic | SEQ ID 2342 | NM_001474 | HS G antigen 4 (GAGE4), mRNA. |
| GAGE12I | exonic | SEQ ID 2343 | NM_001477 | HS G antigen 12I (GAGE12I), mRNA. |
| GAGE7 | exonic | SEQ ID 2344 | NM_021123 | HS G antigen 7 (GAGE7), mRNA. |
| GAGE2B | exonic | SEQ ID 2345 | NM_001098411 | HS G antigen 2B (GAGE2B), mRNA. |
| GAGE1 | exonic | SEQ ID 2346 | NM_001468 | HS G antigen 1 (GAGE1), tv1, mRNA. |
| GAGE12E | exonic | SEQ ID 2347 | NM_001098418 | HS G antigen 12E (GAGE12E), mRNA. |
| GAGE12D | exonic | SEQ ID 2348 | NM_001127199 | HS G antigen 12D (GAGE12D), mRNA. |
| GAGE12H | exonic | SEQ ID 2349 | NM_001098410 | HS G antigen 12H (GAGE12H), mRNA. |
| GAGE12G | exonic | SEQ ID 2350 | NM_001098409 | HS G antigen 12G (GAGE12G), mRNA. |
| GAGE12C | exonic | SEQ ID 2351 | NM_001098408 | HS G antigen 12C (GAGE12C), mRNA. |
| GAGE6 | exonic | SEQ ID 2352 | NM_001476 | HS G antigen 6 (GAGE6), mRNA. |
| GAGE1 | exonic | SEQ ID 2353 | NM_001040663 | HS G antigen 1 (GAGE1), tv2, mRNA. |
| GAGE12B | exonic | SEQ ID 2354 | NM_001127345 | HS G antigen 12B (GAGE12B), mRNA. |
| PAGE1 | exonic | SEQ ID 2355 | NM_003785 | HS P antigen family, member 1 (prostate associated) (PAGE1), mRNA. |
| USP27X | exonic | SEQ ID 2356 | NM_001145073 | HS ubiquitin specific peptidase 27, X-linked (USP27X), mRNA. |
| PAGE4 | exonic | SEQ ID 2357 | NM_007003 | HS P antigen family, member 4 (prostate associated) (PAGE4), mRNA. |
| LOC158572 | exonic | SEQ ID 2358 | NR_026742 | HS uncharacterized LOC158572 (LOC158572), non-coding RNA. |
| MIR362 | exonic | SEQ ID 2359 | NR_029850 | HS microRNA 362 (MIR362), microRNA. |
| MIR502 | exonic | SEQ ID 2360 | NR_030226 | HS microRNA 502 (MIR502), microRNA. |
| MIR501 | exonic | SEQ ID 2361 | NR_030225 | HS microRNA 501 (MIR501), microRNA. |
| MIR500B | exonic | SEQ ID 2362 | NR_036257 | HS microRNA 500b (MIR500B), microRNA. |
| MIR532 | exonic | SEQ ID 2363 | NR_030241 | HS microRNA 532 (MIR532), microRNA. |
| MIR660 | exonic | SEQ ID 2364 | NR_030397 | HS microRNA 660 (MIR660), microRNA. |
| MIR500A | exonic | SEQ ID 2365 | NR_030224 | HS microRNA 500a (MIR500A), microRNA. |
| MIR188 | exonic | SEQ ID 2366 | NR_029708 | HS microRNA 188 (MIR188), microRNA. |
| CLCN5 | exonic | SEQ ID 2367 | NM_000084 | HS chloride channel, voltage-sensitive 5 (CLCN5), tv3, mRNA. |
| AKAP4 | exonic | SEQ ID 2368 | NM_139289 | HS A kinase (PRKA) anchor protein 4 (AKAP4), tv2, mRNA. |
| AKAP4 | exonic | SEQ ID 2369 | NM_003886 | HS A kinase (PRKA) anchor protein 4 (AKAP4), tv1, mRNA. |
| BMP15 | exonic | SEQ ID 2370 | NM_005448 | HS bone morphogenetic protein 15 (BMP15), mRNA. |
| NUDT10 | exonic | SEQ ID 2371 | NM_153183 | HS nudix (nucleoside diphosphate linked moiety X)-type motif 10 (NUDT10), mRNA. |
| NUDT11 | exonic | SEQ ID 2372 | NM_018159 | HS nudix (nucleoside diphosphate linked moiety X)-type motif 11 (NUDT11), mRNA. |
| GSPT2 | exonic | SEQ ID 2373 | NM_018094 | HS G1 to S phase transition 2 (GSPT2), mRNA. |
| CENPVP1 | exonic | SEQ ID 2374 | NR_033772 | HS centromere protein V pseudogene 1 (CENPVP1), non-coding RNA. |
| CENPVP2 | exonic | SEQ ID 2375 | NR_033773 | HS centromere protein V pseudogene 2 (CENPVP2), non-coding RNA. |
| MAGED1 | exonic | SEQ ID 2376 | NM_006986 | HS melanoma antigen family D, 1 (MAGED1), tv2, mRNA. |
| MAGED1 | exonic | SEQ ID 2377 | NM_001005333 | HS melanoma antigen family D, 1 (MAGED1), tv1, mRNA. |
| SNORA11D | exonic | SEQ ID 2378 | NR_003711 | HS small nucleolar RNA, H/ACA box 11D (SNORA11D), small nucleolar RNA. |
| SNORA11E | exonic | SEQ ID 2379 | NR_003712 | HS small nucleolar RNA, H/ACA box 11E (SNORA11E), small nucleolar RNA. |
| MAGED4B | exonic | SEQ ID 2380 | NM_001242362 | HS melanoma antigen family D, 4B (MAGED4B), tv4, mRNA. |
| MAGED4B | exonic | SEQ ID 2381 | NM_030801 | HS melanoma antigen family D, 4B (MAGED4B), tv1, mRNA. |
| MAGED4B | exonic | SEQ ID 2382 | NM_177537 | HS melanoma antigen family D, 4B (MAGED4B), tv3, mRNA. |
| MAGED4B | exonic | SEQ ID 2383 | NM_177535 | HS melanoma antigen family D, 4B (MAGED4B), tv2, mRNA. |
| MAGED4 | exonic | SEQ ID 2384 | NM_001098800 | HS melanoma antigen family D, 4 (MAGED4), tv3, mRNA. |
| XAGE2 | exonic | SEQ ID 2385 | NM_130777 | HS X antigen family, member 2 (XAGE2), mRNA. |
| XAGE2B | exonic | SEQ ID 2386 | NM_001079538 | HS X antigen family, member 2B (XAGE2B), mRNA. |
| SSX8 | exonic | SEQ ID 2387 | NR_027250 | HS synovial sarcoma, X breakpoint 8 (SSX8), non-coding RNA. |
| ALDH1A2 | exonic | SEQ ID 2388 | NM_001206897 | HS aldehyde dehydrogenase 1 family, member A2 (ALDH1A2), tv4, mRNA. |
| ALDH1A2 | exonic | SEQ ID 2389 | NM_003888 | HS aldehyde dehydrogenase 1 family, member A2 (ALDH1A2), tv1, mRNA. |
| ALDH1A2 | exonic | SEQ ID 2390 | NM_170696 | HS aldehyde dehydrogenase 1 family, member A2 (ALDH1A2), tv2, mRNA. |
| ALDH1A2 | exonic | SEQ ID 2391 | NM_170697 | HS aldehyde dehydrogenase 1 family, member A2 (ALDH1A2), tv3, mRNA. |
| CNTN5 | exonic | SEQ ID 2392 | NM_001243271 | HS contactin 5 (CNTN5), tv4, mRNA. |
| CNTN5 | exonic | SEQ ID 2393 | NM_001243270 | HS contactin 5 (CNTN5), tv2, mRNA. |
| CNTN5 | exonic | SEQ ID 2394 | NM_014361 | HS contactin 5 (CNTN5), tv1, mRNA. |
| CNTN5 | exonic | SEQ ID 2395 | NM_175566 | HS contactin 5 (CNTN5), tv3, mRNA. |
| SHANK2 | exonic | SEQ ID 2396 | NM_012309 | HS SH3 and multiple ankyrin repeat domains 2 (SHANK2), tv1, mRNA. |
| SHANK2 | exonic | SEQ ID 2397 | NM_133266 | HS SH3 and multiple ankyrin repeat domains 2 (SHANK2), tv2, mRNA. |
| NSDHL | exonic | SEQ ID 2398 | NM_015922 | HS NAD(P) dependent steroid dehydrogenase-like (NSDHL), tv1, mRNA. |
| NSDHL | exonic | SEQ ID 2399 | NM_001129765 | HS NAD(P) dependent steroid dehydrogenase-like (NSDHL), tv2, mRNA. |
| CETN2 | exonic | SEQ ID 2400 | NM_004344 | HS centrin, EF-hand protein, 2 (CETN2), mRNA. |
| ZNF185 | exonic | SEQ ID 2401 | NM_001178110 | HS zinc finger protein 185 (LIM domain) (ZNF185), tv6, mRNA. |
| ZNF185 | exonic | SEQ ID 2402 | NM_001178109 | HS zinc finger protein 185 (LIM domain) (ZNF185), tv5, mRNA. |
| ZNF185 | exonic | SEQ ID 2403 | NM_001178113 | HS zinc finger protein 185 (LIM domain) (ZNF185), tv7, mRNA. |

TABLE 4-continued

| RefSeq Gene Symbol | CNV Gene Region | SEQ_ID | RefSeq Accession Number | RefSeq Gene Description/Definition (transcript variant = tv; HS = HS) |
|---|---|---|---|---|
| ZNF185 | exonic | SEQ ID 2404 | NM_007150 | HS zinc finger protein 185 (LIM domain) (ZNF185), tv4, mRNA. |
| ZNF185 | exonic | SEQ ID 2405 | NM_001178108 | HS zinc finger protein 185 (LIM domain) (ZNF185), tv3, mRNA. |
| ZNF185 | exonic | SEQ ID 2406 | NM_001178107 | HS zinc finger protein 185 (LIM domain) (ZNF185), tv2, mRNA. |
| ZNF185 | exonic | SEQ ID 2407 | NM_001178106 | HS zinc finger protein 185 (LIM domain) (ZNF185), tv1, mRNA. |
| NRXN1 | exonic | SEQ ID 2408 | NM_004801 | HS neurexin 1 (NRXN1), tvalpha1, mRNA. |
| NRXN1 | exonic | SEQ ID 2409 | NM_001135659 | HS neurexin 1 (NRXN1), tvalpha2, mRNA. |
| NRXN1 | exonic | SEQ ID 2410 | NM_138735 | HS neurexin 1 (NRXN1), tvbeta, mRNA. |
| CNTN4 | exonic | SEQ ID 2411 | NM_001206955 | HS contactin 4 (CNTN4), tv4, mRNA. |
| CNTN4 | exonic | SEQ ID 2412 | NM_001206956 | HS contactin 4 (CNTN4), tv5, mRNA. |
| CNTN4 | exonic | SEQ ID 2413 | NM_175613 | HS contactin 4 (CNTN4), tv3, mRNA. |
| CNTN4 | exonic | SEQ ID 2414 | NM_175607 | HS contactin 4 (CNTN4), tv1, mRNA. |
| DIAPH2 | exonic | SEQ ID 2415 | NM_006729 | HS diaphanous homolog 2 (*Drosophila*) (DIAPH2), tv156, mRNA. |
| DIAPH2 | exonic | SEQ ID 2416 | NM_007309 | HS diaphanous homolog 2 (*Drosophila*) (DIAPH2), tv12C, mRNA. |
| RAB11FIP4 | exonic | SEQ ID 2417 | NM_032932 | HS RAB11 family interacting protein 4 (class II) (RAB11FIP4), mRNA. |

Table 4 represents a list of all genes listed in Table 2 (namely, those relevant to the CNV subregion). Column 1 refers to the gene's name, or also known as the RefSeq gene symbol, as specified by HUGO Gene Nomenclature Committee (www.genenames.org), but it is understood by those skilled in the art that a gene name or RefSeq Gene Symbol (such as are listed in Tables 1-7) may be known by other names as well. Such alternate gene names are commonly listed in the RefSeq entry for the gene under gene synonym in the Features section. Column 2 refers to whether the CNV Gene Region is intronic, exonic, both, or non-coding RNA (ncRNA). "Intronic" refers to CNV subregions affecting introns only; "Exonic" refers to CNV subregions affecting part or all of one or more exons, which may include adjacent intronic regions if the CNV subregion extends beyond the exonic region. Column 3 refers to the assigned sequence ID of the full genomic extent of each of the transcripts. Column 4 refers to the RefSeq RNA Accession number. Column 5 refers to a brief description of an mRNA, or in some cases non-coding RNA, for each respective gene, including multiple mRNA or other RNA entries associated with a gene. In one embodiment, the transcripts listed in Table 4 can be expression products of the gene biomarker as listed in Table 2. In some embodiments, a gene biomarker can comprise genomic DNA encoding the gene, including exons, introns, and/or regulatory binding regions (such as enhancers, promoters, silencers, and/or response elements). In one embodiment, point mutations, polymorphisms, translocations, insertions, deletions, amplifications, inversions, microsatellites, interstitial deletions, copy number variations (CNVs), loss of heterozygosity, or any other aberrations which affect the structure or function of one or more gene biomarkers and/or expression products thereof, are associated with a developmental disorder as described herein. It should be appreciated by those skilled in the art that reference to a CNV gene region can mean a CNV is present in a subject and it impacts part or all of a gene, and similarly it can also mean a CNV subregion present in a subject than impacts part or all of a gene (e.g., a very large CNV may encompass several genes, but only one of the CNV's subregions impacts a specific gene).

TABLE 5

| SEQ ID No | Chr | Original CNV Start | Original CNV Stop | Original CNV Size | CNV type | ASD Case ID(s) | RefSeq Gene Symbol(s) | Exon overlap |
|---|---|---|---|---|---|---|---|---|
| SEQ ID 2418 | 1 | 8415471 | 8424072 | 8601 | Gain | H1M_013111T_SS0795_61878-L_252152923546 | RERE | N |
| SEQ ID 2419 | 1 | 8578840 | 8591521 | 12681 | Loss | H1M_060310R_SS0571_59800L_252152921381 | RERE | N |
| SEQ ID 2420 | 1 | 10018692 | 10025053 | 6361 | Loss | H1M_031110R_SS0386_50002_252152919301 | UBE4B | N |
| SEQ ID 2420 | 1 | 10018692 | 10025053 | 6361 | Loss | H1M_032911T_SS0854_155486L_252152924302 | UBE4B | N |
| SEQ ID 2420 | 1 | 10018692 | 10025053 | 6361 | Loss | H1M_040511T_SS0870_146440L_252152924320 | UBE4B | N |
| SEQ ID 2420 | 1 | 10018692 | 10025053 | 6361 | Loss | H1M_042710R_SS0482_86474_252152921374 | UBE4B | N |
| SEQ ID 2421 | 1 | 97762074 | 97773772 | 11698 | Loss | H1M_092810T_SS0678_82302_252152922076 | DPYD | N |
| SEQ ID 2422 | 1 | 97937467 | 97947871 | 10404 | Loss | H1M_010510R_SS0235_82062L_252152916181 | DPYD | Y |
| SEQ ID 2423 | 1 | 143820620 | 144003268 | 182648 | Gain | H1M_050511T_SS0930_168169_252152924404 | SEC22B, NOTCH2NL | Y |
| SEQ ID 2424 | 1 | 143822673 | 144003268 | 180595 | Gain | H1M_061411R_SS0966_62798L_252152924509 | SEC22B, NOTCH2NL | Y |
| SEQ ID 2425 | 1 | 179248555 | 179264183 | 15628 | Loss | H1M_052010R_SS0531_L051_252152921658 | STX6 | Y |
| SEQ ID 2426 | 1 | 179250347 | 179274360 | 24013 | Loss | H1M_051810R_SS0525_L384_252152921651 | MR1, STX6 | Y |
| SEQ ID 2427 | 1 | 239422311 | 239435974 | 13663 | Loss | H1M_062510R_SS0602_117370L_252152921901 | RGS7 | N |
| SEQ ID 2427 | 1 | 239422311 | 239435974 | 13663 | Loss | H1M_062510R_SS0608_52401_252152921907 | RGS7 | N |
| SEQ ID 2428 | 2 | 31122986 | 31130364 | 7378 | Loss | H1M_031610R_SS0397_67941_252152919353 | GALNT14 | N |
| SEQ ID 2428 | 2 | 31122986 | 31130364 | 7378 | Loss | H1M_100510T_SS0694_100678L_252152922410 | GALNT14 | N |
| SEQ ID 2428 | 2 | 31122986 | 31130364 | 7378 | Loss | H1M_102009R_SS0057_47387_252152914518 | GALNT14 | N |
| SEQ ID 2428 | 2 | 31122986 | 31130364 | 7378 | Loss | H1M_120809R_SS0195_125391_252152914778 | GALNT14 | N |
| SEQ ID 2429 | 2 | 50451929 | 50458853 | 6924 | Loss | H1M_011410bR_SS0286_87396_252152918810 | NRXN1 | N |
| SEQ ID 2430 | 2 | 50707592 | 50720618 | 13026 | Loss | H1M_042710R_SS0484_78391_252152921376 | NRXN1 | Y |
| SEQ ID 2431 | 2 | 50722129 | 50730867 | 8738 | Loss | H1M_103009R_SS0083_122686L_252152914488 | NRXN1 | N |
| SEQ ID 2432 | 2 | 51045326 | 51127104 | 81778 | Loss | H1M_051810R_SS0525_L384_252152921651 | NRXN1 | Y |
| SEQ ID 2433 | 2 | 124806817 | 124830494 | 23677 | Loss | H1M_040511T_SS0868_140059L_252152924318 | CNTNAP5 | N |

TABLE 5-continued

| SEQ ID No | Chr | Original CNV Start | Original CNV Stop | Original CNV Size | CNV type | ASD Case ID(s) | RefSeq Gene Symbol(s) | Exon overlap |
|---|---|---|---|---|---|---|---|---|
| SEQ ID 2434 | 2 | 124812715 | 124830494 | 17779 | Loss | H1M_032310R_SS0424_111520L_252152920373 | CNTNAP5 | N |
| SEQ ID 2435 | 2 | 124820246 | 124830494 | 10248 | Loss | H1M_011410aR_SS0270_129914_252152918777 | CNTNAP5 | N |
| SEQ ID 2436 | 2 | 133432106 | 133451626 | 19520 | Gain | H1M_011410aR_SS0274_62257L_252152918781 | NCKAP5 | Y |
| SEQ ID 2437 | 2 | 133905311 | 133915419 | 10108 | Loss | H1M_061010R_SS0541_88032_252152921473 | NCKAP5 | N |
| SEQ ID 2438 | 2 | 143887081 | 143956653 | 69572 | Loss | H1M_060110R_SS0560_50172L_252152921323 | ARHGAP15 | Y |
| SEQ ID 2439 | 2 | 143888382 | 143916068 | 27686 | Gain | H1M_090910T_SS0635_142468_252152922005 | ARHGAP15 | Y |
| SEQ ID 2440 | 2 | 187939949 | 187948064 | 8115 | Loss | H1M_041211T_SS0888_63586-L_252152924343 | CALCRL | N |
| SEQ ID 2440 | 2 | 187939949 | 187948064 | 8115 | Loss | H1M_050510R_SS0508_103021L_252152921282 | CALCRL | N |
| SEQ ID 2440 | 2 | 187939949 | 187948064 | 8115 | Loss | H1M_051011T_SS0939_62224-L_252152924413 | CALCRL | N |
| SEQ ID 2441 | 2 | 188013560 | 188019828 | 6268 | Loss | H1M_090910T_SS0640_99006_252152922010 | CALCRL | N |
| SEQ ID 2442 | 2 | 212395514 | 212407126 | 11612 | Loss | H1M_042811T_SS0913_138145L_252152924382 | ERBB4 | N |
| SEQ ID 2443 | 2 | 212595621 | 212601943 | 6322 | Loss | H1M_110309R_SS0098_90188_252152914565 | ERBB4 | N |
| SEQ ID 2444 | 2 | 230027762 | 230036470 | 8708 | Loss | H1M_062110R_SS0599_143189_252152921898 | DNER | N |
| SEQ ID 2444 | 2 | 230027762 | 230036470 | 8708 | Loss | H1M_100609R_SS0029_93919L_252152914858 | DNER | N |
| SEQ ID 2445 | 2 | 238945136 | 238954610 | 9474 | Loss | H1M_010510R_SS0245_57842L_252152918506 | TRAF3IP1 | N |
| SEQ ID 2445 | 2 | 238945136 | 238954610 | 9474 | Gain | H1M_091410T_SS0641_115738L_252152922011 | TRAF3IP1 | N |
| SEQ ID 2446 | 3 | 59831948 | 59843515 | 11567 | Loss | H1M_012511T_SS0791_57928_252152923637 | FHIT | N |
| SEQ ID 2447 | 3 | 59891746 | 60074408 | 182662 | Loss | H1M_112609R_SS0162_68637L_252152914709 | FHIT | Y |
| SEQ ID 2448 | 3 | 60310452 | 60323411 | 12959 | Loss | H1M_042111T_SS0960_83152L_252152914375 | FHIT | N |
| SEQ ID 2449 | 3 | 60635843 | 60968263 | 332420 | Loss | H1M_051810R_SS0527_L656_252152921653 | FHIT | Y |
| SEQ ID 2450 | 3 | 60814214 | 60829360 | 15146 | Loss | H1M_102709R_SS0073_60701L_252152914480 | FHIT | N |
| SEQ ID 2451 | 3 | 77559671 | 77571280 | 11609 | Loss | H1M_050311T_SS0927_156900_252152924401 | ROBO2 | N |
| SEQ ID 2451 | 3 | 77559671 | 77571280 | 11609 | Loss | H1M_061510R_SS0589_52335_252152921712 | ROBO2 | N |
| SEQ ID 2452 | 4 | 57676862 | 57683744 | 6882 | Loss | H1M_062510R_SS0610_128122_252152921909 | LOC255130 | N |
| SEQ ID 2453 | 4 | 57708111 | 57723394 | 15283 | Loss | H1M_060110R_SS0558_83555L_252152921303 | LOC255130 | N |
| SEQ ID 2454 | 4 | 81084565 | 81107218 | 22653 | Gain | H1M_092810T_SS0672_55262-L_252152921992 | ANTXR2 | N |
| SEQ ID 2454 | 4 | 81084565 | 81107218 | 22653 | Gain | H1M_122309R_SS0232_61384_252152916118 | ANTXR2 | N |
| SEQ ID 2455 | 4 | 93780494 | 93794806 | 14312 | Loss | H1M_062510R_SS0609_51165L_252152921908 | GRID2 | N |
| SEQ ID 2455 | 4 | 93780494 | 93794806 | 14312 | Loss | H1M_120309R_SS0177_96086L_252152914841 | GRID2 | N |
| SEQ ID 2456 | 4 | 93783990 | 93794806 | 10816 | Loss | H1M_033111T_SS0862_139459L_252152924312 | GRID2 | N |
| SEQ ID 2456 | 4 | 93783990 | 93794806 | 10816 | Loss | H1M_122109R_SS0211_101464_252152914903 | GRID2 | N |
| SEQ ID 2457 | 4 | 94167265 | 94186125 | 18860 | Loss | H1M_041510R_SS0457_60685L_252152921062 | GRID2 | N |
| SEQ ID 2458 | 4 | 100954989 | 101000711 | 45722 | Gain | H1M_032510R_SS0432_115813L_252152920381 | DAPP1 | Y |
| SEQ ID 2458 | 4 | 100954989 | 101000711 | 45722 | Gain | H1M_103009R_SS0093_117463L_252152914570 | DAPP1 | Y |
| SEQ ID 2459 | 4 | 119333328 | 119349029 | 15701 | Loss | H1M_093010T_SS0684_117371L_252152922370 | NDST3 | N |
| SEQ ID 2459 | 4 | 119333328 | 119349029 | 15701 | Loss | H1M_111709R_SS0124_82366_252152914823 | NDST3 | N |
| SEQ ID 2459 | 4 | 119333328 | 119349029 | 15701 | Loss | H1M_111909R_SS0133_64249L_252152914832 | NDST3 | N |
| SEQ ID 2460 | 4 | 119333615 | 119349029 | 15414 | Loss | H1M_101910T_SS0718_100573L_252152921190 | NDST3 | Y |
| SEQ ID 2461 | 5 | 78410721 | 78424190 | 13469 | Gain | H1M_051110R_SS0513_49202_252152921758 | BHMT2 | Y |
| SEQ ID 2462 | 5 | 78412278 | 78427595 | 15317 | Gain | H1M_042110R_SS0472_62261L_252152921260 | BHMT2 | Y |
| SEQ ID 2463 | 5 | 112548119 | 112556605 | 8486 | Loss | H1M_050510R_SS0500_72296_252152921461 | MCC | N |
| SEQ ID 2464 | 5 | 112699032 | 112724865 | 25833 | Loss | H1M_060310R_SS0568_59269L_252152921343 | MCC | Y |
| SEQ ID 2465 | 5 | 146286927 | 146295686 | 8759 | Loss | H1M_100609R_SS0023_117486L_252152914648 | PPP2R2B | N |
| SEQ ID 2465 | 5 | 146286927 | 146295686 | 8759 | Loss | H1M_102709R_SS0081_45562_252152914584 | PPP2R2B | N |
| SEQ ID 2466 | 5 | 180507805 | 180542040 | 34235 | Gain | H1M_042111T_SS0902_83680L_252152924371 | OR2V2 | Y |
| SEQ ID 2466 | 5 | 180507805 | 180542040 | 34235 | Gain | H1M_111909R_SS0133_64249L_252152914832 | OR2V2 | Y |
| SEQ ID 2467 | 6 | 33490909 | 33506174 | 15265 | Loss | H1M_122109R_SS0211_101464_252152914903 | SYNGAP1, CUTA, PHF1 | Y |
| SEQ ID 2468 | 6 | 33490909 | 33507787 | 16878 | Loss | H1M_020210R_SS0297_96241_252152918826 | SYNGAP1, CUTA, PHF1 | Y |
| SEQ ID 2469 | 6 | 33492194 | 33506174 | 13980 | Loss | H1M_111909R_SS0133_64249L_252152914832 | SYNGAP1, CUTA, PHF1 | Y |
| SEQ ID 2470 | 6 | 38069512 | 38093797 | 24285 | Gain | H1M_021710R_SS0327_60416_252152919127 | ZFAND3 | N |
| SEQ ID 2470 | 6 | 38069512 | 38093797 | 24285 | Gain | H1M_031610R_SS0399_68672_252152919360 | ZFAND3 | N |
| SEQ ID 2471 | 6 | 65407331 | 65423639 | 16308 | Loss | H1M_051810R_SS0527_L656_252152921653 | EYS | N |
| SEQ ID 2472 | 6 | 65844562 | 65871185 | 26623 | Loss | H1M_032310R_SS0425_65891_252152920374 | EYS | N |
| SEQ ID 2472 | 6 | 65844562 | 65871185 | 26623 | Loss | H1M_041411T_SS0892_157660L_252152924347 | EYS | N |
| SEQ ID 2473 | 6 | 66130866 | 66137447 | 6581 | Loss | H1M_010510R_SS0238_92121_252152916184 | EYS | N |
| SEQ ID 2473 | 6 | 66130866 | 66137447 | 6581 | Loss | H1M_031110R_SS0390_85983_252152919320 | EYS | N |
| SEQ ID 2473 | 6 | 66130866 | 66137447 | 6581 | Loss | H1M_042110R_SS0474_47836_252152921321 | EYS | N |
| SEQ ID 2474 | 7 | 26020603 | 26172358 | 151755 | Gain | H1M_061411R_SS0964_83548L_252152910796 | NFE2L3 | Y |
| SEQ ID 2475 | 7 | 26180912 | 26202927 | 22015 | Gain | H1M_020211T_SS0806_125855_252152924196 | NFE2L3, HNRNPA2B1 | Y |
| SEQ ID 2476 | 7 | 43210229 | 43217598 | 7369 | Loss | H1M_032310R_SS0418_68160L_252152920367 | HECW1 | N |
| SEQ ID 2476 | 7 | 43210229 | 43217598 | 7369 | Loss | H1M_100510T_SS0689_67955-L_252152922405 | HECW1 | N |
| SEQ ID 2476 | 7 | 43210229 | 43217598 | 7369 | Loss | H1M_103009R_SS0085_60576_252152914490 | HECW1 | N |
| SEQ ID 2477 | 7 | 45079797 | 45096230 | 16433 | Loss | H1M_100609R_SS0026_47909_252152914651 | NACAD, CCM2 | Y |
| SEQ ID 2477 | 7 | 45079797 | 45096230 | 16433 | Loss | H1M_103009R_SS0087_62391L_252152914539 | NACAD, CCM2 | Y |
| SEQ ID 2478 | 7 | 124324707 | 124335800 | 11093 | Gain | H1M_031110R_SS0388_119776_252152919318 | POT1 | Y |
| SEQ ID 2478 | 7 | 124324707 | 124335800 | 11093 | Gain | H1M_110309R_SS0095_44644_252152914411 | POT1 | Y |

TABLE 5-continued

| SEQ ID No | Chr | Original CNV Start | Original CNV Stop | Original CNV Size | CNV type | ASD Case ID(s) | RefSeq Gene Symbol(s) | Exon overlap |
|---|---|---|---|---|---|---|---|---|
| SEQ ID 2479 | 7 | 126121250 | 126155919 | 34669 | Gain | H1M_102610T_SS0734_128860_252152922183 | GRM8 | Y |
| SEQ ID 2480 | 7 | 126272537 | 126289499 | 16962 | Gain | H1M_040711T_SS0873_146436L_252152924324 | GRM8 | N |
| SEQ ID 2481 | 7 | 126580660 | 126602515 | 21855 | Loss | H1M_091010T_SS0634_130293_252152922004 | GRM8 | N |
| SEQ ID 2482 | 7 | 127640443 | 127676111 | 35668 | Gain | H1M_062910R_SS0617_91617_252152921900 | LEP | Y |
| SEQ ID 2483 | 7 | 127640443 | 127678365 | 37922 | Gain | H1M_011410aR_SS0277_45751_252152918784 | LEP | Y |
| SEQ ID 2484 | 7 | 131704792 | 131719045 | 14253 | Loss | H1M_070810R_SS0622_69180_252152921936 | PLXNA4 | Y |
| SEQ ID 2485 | 7 | 131972774 | 131988294 | 15520 | Gain | H1M_092410T_SS0664_59144_252152921962 | PLXNA4 | Y |
| SEQ ID 2486 | 7 | 142175874 | 142198576 | 22702 | Loss | H1M_050311T_SS0925_154624L_252152924399 | PRSS2 | Y |
| SEQ ID 2486 | 7 | 142175874 | 142198576 | 22702 | Loss | H1M_022211T_SS0811_162340L_252152924211 | PRSS2 | Y |
| SEQ ID 2487 | 7 | 142175874 | 142206030 | 30156 | Loss | H1M_031011T_SS0820_54259_252152924504 | PRSS2 | Y |
| SEQ ID 2487 | 7 | 142175874 | 142206030 | 30156 | Loss | H1M_050511T_SS0936_128963_252152924410 | PRSS2 | Y |
| SEQ ID 2487 | 7 | 142175874 | 142206030 | 30156 | Loss | H1M_090910T_SS0637_77114_252152922007 | PRSS2 | Y |
| SEQ ID 2488 | 7 | 157158010 | 157165854 | 7844 | Loss | H1M_102009R_SS0074_107433_252152914512 | PTPRN2 | N |
| SEQ ID 2489 | 7 | 157224935 | 157298194 | 73259 | Gain | H1M_050510R_SS0501_72057_252152921496 | PTPRN2 | N |
| SEQ ID 2490 | 8 | 42687678 | 42703550 | 15872 | Gain | H1M_110309T_SS0095_44644_252152914411 | CHRNB3 | N |
| SEQ ID 2491 | 8 | 42691586 | 42703550 | 11964 | Loss | H1M_030311T_SS0817_65690_252152924275 | CHRNB3 | N |
| SEQ ID 2492 | 8 | 145990558 | 146003494 | 12936 | Loss | H1M_011410aR_SS0275_47389_252152918782 | ZNF517 | Y |
| SEQ ID 2492 | 8 | 145990558 | 146003494 | 12936 | Loss | H1M_122109T_SS0219_110612L_252152916081 | ZNF517 | Y |
| SEQ ID 2493 | 9 | 21250172 | 21268145 | 17973 | Gain | H1M_031810R_SS0410_69354_252152919401 | IFNA22P | Y |
| SEQ ID 2493 | 9 | 21250172 | 21268145 | 17973 | Gain | H1M_050510R_SS0510_55360_252152921284 | IFNA22P | Y |
| SEQ ID 2494 | 9 | 93432583 | 93440062 | 7479 | Loss | H1M_061510R_SS0585_60666L_252152921685 | MIR3910-1, MIR3910-2 | Y |
| SEQ ID 2494 | 9 | 93432583 | 93440062 | 7479 | Loss | H1M_062510R_SS0606_117525L_252152921905 | MIR3910-1, M1R3910-2 | Y |
| SEQ ID 2494 | 9 | 93432583 | 93440062 | 7479 | Loss | H1M_110210T_SS0754_60973L_252152922357 | MIR3910-1, MIR3910-2 | Y |
| SEQ ID 2495 | 10 | 67439723 | 67447839 | 8116 | Loss | H1M_060310R_SS0576_118909L_252152921401 | CTNNA3 | N |
| SEQ ID 2496 | 10 | 68761434 | 68779805 | 18371 | Loss | H1M_100209R_SS0014_95578_252152914604 | CTNNA3 | N |
| SEQ ID 2497 | 10 | 77916018 | 77928938 | 12920 | Gain | H1M_030910R_SS0379_MM0234-5_252152919292 | C10orf11 | N |
| SEQ ID 2497 | 10 | 77916018 | 77928938 | 12920 | Gain | H1M_042910R_SS0495_68388_252152921455 | C10orf11 | N |
| SEQ ID 2498 | 10 | 77917670 | 77928938 | 11268 | Gain | H1M_050510R_SS0501_72057_252152921496 | C10orf11 | N |
| SEQ ID 2499 | 10 | 103148325 | 103156849 | 8524 | Gain | H1M_042710R_SS0477_45758_252152921364 | BTRC | N |
| SEQ ID 2499 | 10 | 103148325 | 103156849 | 8524 | Gain | H1M_060810R_SS0543_95746_252152921403 | BTRC | N |
| SEQ ID 2500 | 11 | 10067279 | 10107273 | 39994 | Loss | H1M_050510R_SS0500_72296_252152921461 | SBF2 | N |
| SEQ ID 2501 | 11 | 10116873 | 10123876 | 7003 | Loss | H1M_032310R_SS0419_55449_252152920368 | SBF2 | N |
| SEQ ID 2501 | 11 | 10116873 | 10123876 | 7003 | Loss | H1M_092410T_SS0670_85276L_252152921990 | SBF2 | N |
| SEQ ID 2501 | 11 | 10116873 | 10123876 | 7003 | Loss | H1M_121009R_SS0207_95011_252152914854 | SBF2 | N |
| SEQ ID 2502 | 11 | 43728776 | 43739172 | 10396 | Loss | H1M_050311T_SS0922_155493L_252152924396 | HSD17B12 | Y |
| SEQ ID 2502 | 11 | 43728776 | 43739172 | 10396 | Loss | H1M_050511T_SS0933_170300_252152924407 | HSD17B12 | Y |
| SEQ ID 2503 | 11 | 89473890 | 89516888 | 42998 | Loss | H1M_103009R_SS0084_82921L_252152914489 | NAALAD2 | Y |
| SEQ ID 2504 | 11 | 89546524 | 89558793 | 12269 | Loss | H1M_103009R_SS0084_82921L_252152914489 | NAALAD2 | Y |
| SEQ ID 2505 | 12 | 1321756 | 1332345 | 10589 | Loss | H1M_020210R_SS0295_90412_252152918824 | ERC1 | N |
| SEQ ID 2506 | 12 | 1432461 | 1447783 | 15322 | Gain | H1M_061411R_SS0961_168866_252152910793 | ERC1 | N |
| SEQ ID 2507 | 12 | 110497497 | 110510158 | 12661 | Loss | H1M_050311T_SS0928_167532_252152924402 | ATXN2 | N |
| SEQ ID 2507 | 12 | 110497497 | 110510158 | 12661 | Loss | H1M_100510T_SS0692_136064_252152924408 | ATXN2 | N |
| SEQ ID 2507 | 12 | 110497497 | 110510158 | 12661 | Loss | H1M_101910T_SS0712_67766_252152922504 | ATXN2 | N |
| SEQ ID 2508 | 12 | 110497497 | 110512690 | 15193 | Loss | H1M_032211T_SS0842_146904L_252152924290 | ATXN2 | N |
| SEQ ID 2509 | 12 | 119355152 | 119372694 | 17542 | Gain | H1M_042110R_SS0465_60811_252152921077 | GATC, COX6A1, TRIAP1 | Y |
| SEQ ID 2509 | 12 | 119355152 | 119372694 | 17542 | Gain | H1M_050311T_SS0923_155571L_252152924397 | GATC, COX6A1, TRIAP1 | Y |
| SEQ ID 2509 | 12 | 119355152 | 119372694 | 17542 | Gain | H1M_101510T_SS0708_137484_252152922500 | GATC, COX6A1, TRIAP1 | Y |
| SEQ ID 2510 | 14 | 66255943 | 66292122 | 36179 | Loss | H1M_120109R_SS0175_103018L_252152914810 | GPHN | N |
| SEQ ID 2511 | 14 | 78094937 | 78108997 | 14060 | Loss | H1M_051810R_SS0524_102350_252152921650 | NRXN3 | N |
| SEQ ID 2512 | 14 | 79195282 | 79484992 | 289710 | Loss | H1M_122309R_SS0222_95458L_252152916084 | NRXN3 | Y |
| SEQ ID 2513 | 14 | 100004394 | 100013283 | 8889 | Loss | H1M_062510R_SS0603_59794L_252152921902 | WDR25 | N |
| SEQ ID 2513 | 14 | 100004394 | 100013283 | 8889 | Loss | H1M_120109R_SS0167_77405L_252152914704 | WDR25 | N |
| SEQ ID 2514 | 15 | 40000247 | 40008898 | 8651 | Loss | H1M_050311T_SS0927_156900_252152924401 | EHD4 | N |
| SEQ ID 2514 | 15 | 40000247 | 40008898 | 8651 | Loss | H1M_110410T_SS0768_59962-L_252152922532 | EHD4 | N |
| SEQ ID 2515 | 15 | 76203086 | 76226626 | 23540 | Gain | H1M_020210R_SS0300_117395L_252152918834 | CIB2 | Y |
| SEQ ID 2516 | 15 | 76205943 | 76223581 | 17638 | Gain | H1M_051810R_SS0753_94478_252152923346 | CIB2 | Y |
| SEQ ID 2517 | 15 | 76205943 | 76224670 | 18727 | Gain | H1M_041411T_SS0890_132199L_252152924345 | CIB2 | Y |
| SEQ ID 2518 | 16 | 3047397 | 3065441 | 18044 | Loss | H1M_042910R_SS0488_110408_252152921409 | MMP25, IL32 | Y |
| SEQ ID 2518 | 16 | 3047397 | 3065441 | 18044 | Loss | H1M_110210T_SS0754_60973L_252152922357 | MMP25, IL32 | Y |
| SEQ ID 2519 | 16 | 86251131 | 86263122 | 11991 | Gain | H1M_011410aR_SS0277_45751_252152918784 | JPH3 | N |
| SEQ ID 2520 | 16 | 86267253 | 86273542 | 6289 | Loss | H1M_092410T_SS0665_92812_252152921963 | JPH3 | N |
| SEQ ID 2521 | 16 | 86306880 | 86326994 | 20114 | Loss | H1M_011410aR_SS0269_MM0196-4_252152918776 | KLHDC4 | Y |

TABLE 5-continued

| SEQ ID No | Chr | Original CNV Start | Original CNV Stop | Original CNV Size | CNV type | ASD Case ID(s) | RefSeq Gene Symbol(s) | Exon overlap |
|---|---|---|---|---|---|---|---|---|
| SEQ ID 2522 | 16 | 86346896 | 86364864 | 17968 | Loss | H1M__122309R__SS0227__68711__252152916113 | KLHDC4 | Y |
| SEQ ID 2523 | 17 | 1182304 | 1207115 | 24811 | Gain | H1M__031610R__SS0399__68672__252152919360 | YWHAE | Y |
| SEQ ID 2524 | 17 | 4617476 | 4629828 | 12352 | Loss | H1M__060310R__SS0574__64374L__252152921399 | TM4SF5 | Y |
| SEQ ID 2524 | 17 | 4617476 | 4629828 | 12352 | Loss | H1M__110309R__SS0095__44644__252152914411 | TM4SF5 | Y |
| SEQ ID 2525 | 17 | 10288578 | 10297580 | 9002 | Loss | H1M__060310R__SS0554__59902L__252152921341 | MYH4 | Y |
| SEQ ID 2525 | 17 | 10288578 | 10297580 | 9002 | Loss | H1M__090910T__SS0636__114094L__252152922006 | MYH4 | Y |
| SEQ ID 2526 | 17 | 56212732 | 56222563 | 9831 | Loss | H1M__011311T__SS0787__63582-L__252152923633 | BCAS3 | N |
| SEQ ID 2526 | 17 | 56212732 | 56222563 | 9831 | Loss | H1M__062110R__SS0601__91617__252152921900 | BCAS3 | N |
| SEQ ID 2526 | 17 | 56212732 | 56222563 | 9831 | Loss | H1M__110509R__SS0108__83553L__252152914788 | BCAS3 | N |
| SEQ ID 2527 | 19 | 18154567 | 18171834 | 17267 | Gain | H1M__032911R__SS0850__154267L__252152924298 | RAB3A, MPV17L2 | Y |
| SEQ ID 2528 | 19 | 18154567 | 18174395 | 19828 | Gain | H1M__092410T__SS0660__66673__252152921918 | RAB3A, MPV17L2 | Y |
| SEQ ID 2529 | 19 | 45711646 | 45808780 | 97134 | Loss | H1M__102810T__SS0739__61360__252152922199 | SPTBN4, SHKBP1, LTBP4 | Y |
| SEQ ID 2530 | 19 | 45752434 | 45808780 | 56346 | Loss | H1M__110210T__SS0758__126047__252152922361 | SPTBN4, SHKBP1, LTBP4 | Y |
| SEQ ID 2531 | 19 | 52315324 | 52340052 | 24728 | Gain | H1M__031011T__SS0821__45554__252152924321 | SAE1 | Y |
| SEQ ID 2531 | 19 | 52315324 | 52340052 | 24728 | Gain | H1M__100510T__SS0691__124475__252152922407 | SAE1 | Y |
| SEQ ID 2531 | 19 | 52315324 | 52340052 | 24728 | Gain | H1M__110309R__SS0095__44644__252152914411 | SAE1 | Y |
| SEQ ID 2532 | 19 | 55872843 | 55934778 | 61935 | Loss | H1M__030311T__SS0813__168753__252152924272 | SHANK1, CLEC11A | Y |
| SEQ ID 2533 | 19 | 56882402 | 56889637 | 7235 | Loss | H1M__093010T__SS0684__117371L__252152922370 | MIR99B, MIRLET7E, MIR125A, NCRNA00085 | Y |
| SEQ ID 2533 | 19 | 56882402 | 56889637 | 7235 | Loss | H1M__102110T__SS0724__59724-L__252152922157 | MIR99B, MIRLET7E, MIR125A, NCRNA00085 | Y |
| SEQ ID 2533 | 19 | 56882402 | 56889637 | 7235 | Loss | H1M__111909R__SS0137__100677L__252152914836 | MIR99B, MIRLET7E, MIR125A, NCRNA00085 | Y |
| SEQ ID 2534 | 20 | 314677 | 331942 | 17265 | Loss | H1M__111909R__SS0137__100677L__252152914836 | TRIB3 | Y |
| SEQ ID 2535 | 20 | 314677 | 326132 | 11455 | Loss | H1M__041510R__SS0475__62251L__252152921074 | TRIB3 | Y |
| SEQ ID 2536 | 20 | 3827236 | 3831572 | 4336 | Loss | H1M__033110R__SS0449__55497__252152920408 | PANK2 | N |
| SEQ ID 2536 | 20 | 3827236 | 3831572 | 4336 | Loss | H1M__051110R__SS0513__49202__252152921758 | PANK2 | N |
| SEQ ID 2536 | 20 | 3827236 | 3831572 | 4336 | Loss | H1M__110210T__SS0754__60973L__252152922357 | PANK2 | N |
| SEQ ID 2536 | 20 | 3827236 | 3831572 | 4336 | Loss | H1M__110210T__SS0758__126047__252152922361 | PANK2 | N |
| SEQ ID 2537 | 21 | 16479907 | 16550832 | 70925 | Loss | H1M__102810T__SS0744__58016__252152922216 | C21orf34 | Y |
| SEQ ID 2538 | 21 | 16698731 | 16710463 | 11732 | Loss | H1M__031610R__SS0399__68672__252152919360 | C21orf34 | N |
| SEQ ID 2539 | X | 2014899 | 2290904 | 276005 | Gain | H1M__011410aR__SS0273__62227L__252152921858 | DHRSX | Y |
| SEQ ID 2540 | X | 2019039 | 2184946 | 165907 | Gain | H1M__102810T__SS0748__32794__252152922219 | DHRSX | Y |
| SEQ ID 2540 | X | 2019039 | 2184946 | 165907 | Gain | H1M__120109R__SS0173__101121L__252152914808 | DHRSX | Y |
| SEQ ID 2541 | X | 2128189 | 2390326 | 262137 | Gain | H1M__032911R__SS0850__154267L__252152924298 | DHRSX | Y |
| SEQ ID 2542 | X | 2239268 | 2262969 | 23728 | Gain | H1M__031110R__SS0389__143178__252152919319 | DHRSX | N |
| SEQ ID 2543 | X | 2282899 | 2289078 | 6179 | Loss | H1M__031110R__SS0389__143178__252152919319 | DHRSX | N |
| SEQ ID 2544 | X | 2288678 | 2313952 | 25274 | Loss | H1M__062510R__SS0608__52401__252152921907 | DHRSX | N |
| SEQ ID 2545 | X | 2290478 | 2313952 | 23474 | Loss | H1M__020210R__SS0301__114961L__252152918835 | DHRSX | N |
| SEQ ID 2546 | X | 2302992 | 2307482 | 4490 | Loss | H1M__100209R__SS0013__47029__252152914603 | DHRSX | N |
| SEQ ID 2546 | X | 2302992 | 2307482 | 4490 | Loss | H1M__101510R__SS0705__131698__252152922492 | DHRSX | N |
| SEQ ID 2547 | X | 2319097 | 2325935 | 6838 | Loss | H1M__112609R__SS0164__72085__252152914711 | DHRSX | N |
| SEQ ID 2548 | X | 2382384 | 2385428 | 3044 | Loss | H1M__010710R__SS0246__57224L__252152918507 | DHRSX | N |
| SEQ ID 2548 | X | 2382384 | 2385428 | 3044 | Loss | H1M__102610T__SS0735__54089__252152922184 | DHRSX | N |
| SEQ ID 2549 | X | 16688233 | 16707403 | 19170 | Gain | H1M__051810R__SS0521__58294L__252152921647 | SYAP1 | Y |
| SEQ ID 2549 | X | 16688233 | 16707403 | 19170 | Gain | H1M__060810R__SS0579__55310__252152921451 | SYAP1 | Y |
| SEQ ID 2550 | X | 23760070 | 23778530 | 18460 | Gain | H1M__041411T__SS0894__139353L__252152924331 | APOO | Y |
| SEQ ID 2551 | X | 23761433 | 23778530 | 17097 | Gain | H1M__050511T__SS0933__170300__252152924407 | APOO | Y |
| SEQ ID 2552 | X | 32004122 | 32019493 | 15371 | Gain | H1M__030910R__SS0376__59641L__252152921984 | DMD | N |
| SEQ ID 2553 | X | 32574048 | 32580308 | 6260 | Loss | H1M__031610R__SS0394__100570L__252152919350 | DMD | N |
| SEQ ID 2554 | X | 32905207 | 32928210 | 23003 | Loss | H1M__011210R__SS0260__62231L__252152918755 | DMD | N |
| SEQ ID 2555 | X | 33069644 | 33076560 | 6916 | Loss | H1M__100209R__SS0020__91548L__252152914820 | DMD | N |
| SEQ ID 2556 | X | 95853392 | 95864822 | 11430 | Loss | H1M__041411T__SS0889__117482L__252152924344 | DIAPH2 | N |
| SEQ ID 2557 | X | 96415067 | 96426115 | 11048 | Loss | H1M__110410T__SS0771__47556__252152922556 | DIAPH2 | N |

* Position references refer to the human genomic sequence Hg18 Mar. 2006 (NCBI Build 36.1)

Table 5 lists all CNVs of interest, obtained using the method described in example 2. For each entry, the originating CNV start and stop positions are noted, along with CNV size, CNV type (gain, loss or both), ASD cases IDs, RefSeq gene symbols and whether or not the CNV overlaps an exon. Unlike Table 2, the gene annotation refers to the (original) CNV as detailed in the table.

TABLE 6

| GENE NAME | Gene ID # | CNV type | CNV Gene Region | NCBI Gene ID | Gene Description | RefSeq Summmary |
|---|---|---|---|---|---|---|
| ANTXR2 | 452 | Gain | Intronic | 118429 | anthrax toxin receptor 2 isoform 1 precursor | This gene encodes a receptor for anthrax toxin. The protein binds to collagen IV and laminin, suggesting that it may be involved in extracellular matrix adhesion. Mutations in this gene cause juvenile hyaline fibromatosis and infantile systemic hyalinosis. Multiple transcript variants encoding different isoforms have been found for this gene. [provided by RefSeq, March 2009]. Transcript Variant: This variant (2) uses an alternate 3' splice pattern, compared to variant 1. The resulting isoform (2) has a longer and distinct C-terminus, compared to isoform 1. |
| APOO | 453 | Gain | Exonic | 79135 | apolipoprotein O precursor | This gene is a member of the apolipoprotein family. Members of this protein family are involved in the transport and metabolism of lipids. The encoded protein associates with HDL, LDL and VLDL lipoproteins and is characterized by chondroitin-sulfate glycosylation. This protein may be involved in preventing lipid accumulation in the myocardium in obese and diabetic patients. Alternative splicing results in multiple transcript variants. Pseudogenes of this gene are found on chromosomes 3, 4, 5, 12 and 16. [provided by RefSeq, September 2009]. Transcript Variant: This variant (1) represents the longer transcript and is predicted to encode the functional protein. |
| ARHGAP15 | 454 | Both | Exonic | 55843 | rho GTPase-activating protein 15 | RHO GTPases (see ARHA; MIM 165390) regulate diverse biologic processes, and their activity is regulated by RHO GTPase-activating proteins (GAPs), such as ARHGAP15 (Seoh et al., 2003 [PubMed 12650940]). [supplied by OMIM, March 2008]. |
| ATXN2 | 455 | Loss | Intronic | 6311 | ataxin-2 | The autosomal dominant cerebellar ataxias (ADCA) are a heterogeneous group of neurodegenerative disorders characterized by progressive degeneration of the cerebellum, brain stem and spinal cord. Clinically, ADCA has been divided into three groups: ADCA types I-III. Defects in this gene are the cause of spinocerebellar ataxia type 2 (SCA2). SCA2 belongs to the autosomal dominant cerebellar ataxias type I (ADCA I) which are characterized by cerebellar ataxia in combination with additional clinical features like optic atrophy, ophthalmoplegia, bulbar and extrapyramidal signs, peripheral neuropathy and dementia. SCA2 is caused by expansion of a CAG repeat in the coding region of this gene. This locus has been mapped to chromosome 12, and it has been determined that the diseased allele contains 37-50 CAG repeats, compared to 17-29 in the normal allele. Longer expansions result in earlier onset of the disease. Alternatively spliced transcript variants encoding different isoforms have been identified but their full length sequence has not been determined. [provided by RefSeq, January 2010]. |
| BCAS3 | 456 | Loss | Intronic | 54828 | breast carcinoma-amplified sequence 3 isoform 1 | N/A |
| BHMT2 | 457 | Gain | Exonic | 23743 | betaine--homocysteine S-methyltransferase 2 isoform 2 | Homocysteine is a sulfur-containing amino acid that plays a crucial role in methylation reactions. Transfer of the methyl group from betaine to homocysteine creates methionine, which donates the methyl group to methylate DNA, proteins, lipids, and other intracellular metabolites. The protein encoded by this gene is one of two methyl transferases that can catalyze the transfer of the methyl group from betaine to homocysteine. Anomalies in homocysteine metabolism have been implicated in disorders ranging from vascular disease to neural tube birth defects such as spina bifida. Alternatively spliced transcript variants encoding different isoforms have been found for this gene. [provided by RefSeq, May 2010]. Transcript Variant: This variant (2) lacks an in-frame exon in the CDS, as compared to variant 1. The resulting isoform (2) lacks an internal segment, as compared to isoform 1. Sequence Note: This RefSeq record was created from transcript and genomic sequence data to make the sequence |

TABLE 6-continued

| GENE NAME | Gene ID # | CNV type | CNV Gene Region | NCBI Gene ID | Gene Description | RefSeq Summary |
|---|---|---|---|---|---|---|
| BTRC | 458 | Gain | Intronic | 8945 | F-box/WD repeat-containing protein 1A isoform 2 | consistent with the reference genome assembly. The genomic coordinates used for the transcript record were based on transcript alignments. Publication Note: This RefSeq record includes a subset of the publications that are available for this gene. Please see the Gene record to access additional publications. This gene encodes a member of the F-box protein family which is characterized by an approximately 40 amino acid motif, the F-box. The F-box proteins constitute one of the four subunits of ubiquitin protein ligase complex called SCFs (SKP1-cullin-F-box), which function in phosphorylation-dependent ubiquitination. The F-box proteins are divided into 3 classes: Fbws containing WD-40 domains, Fbls containing leucine-rich repeats, and Fbxs containing either different protein-protein interaction modules or no recognizable motifs. The protein encoded by this gene belongs to the Fbws class; in addition to an F-box, this protein contains multiple WD-40 repeats. This protein is homologous to Xenopus bTrCP1, yeast Met30, Neurospora Scon2 and Drosophila Slimb proteins. It interacts with HIV-1 Vpu and connects CD4 to the proteolytic machinery. It also associates specifically with phosphorylated IkappaBalpha and beta-catenin destruction motifs, probably functioning in multiple transcriptional programs by activating the NF-kappaB pathway and inhibiting the beta-catenin pathway. [provided by RefSeq, July 2008]. Transcript Variant: This variant (2) lacks a 108 nt fragment within the coding region, as compared to variant 1, and thus encodes a 36 aa shorter isoform than variant 1. Sequence Note: The RefSeq transcript and protein were derived from genomic sequence to make the sequence consistent with the reference genome assembly. The genomic coordinates used for the transcript record were based on alignments. |
| C10orf11 | 459 | Gain | Intronic | 83938 | leucine-rich repeat-containing protein C10orf11 | N/A |
| C21orf34 | 460 | Loss | Both | N/A | N/A | N/A |
| CALCRL | 461 | Loss | Intronic | 10203 | calcitonin gene-related peptide type 1 receptor precursor | N/A |
| CCM2 | 462 | Loss | Exonic | 83605 | malcavernin isoform 4 | This gene encodes a scaffold protein that functions in the stress-activated p38 Mitogen-activated protein kinase (MAPK) signaling cascade. The protein interacts with SMAD specific E3 ubiquitin protein ligase 1 (also known as SMURF1) via a phosphotyrosine binding domain to promote RhoA degradation. The protein is required for normal cytoskeletal structure, cell-cell interactions, and lumen formation in endothelial cells. Mutations in this gene result in cerebral cavernous malformations. Multiple transcript variants encoding different isoforms have been found for this gene. [provided by RefSeq, November 2009]. Transcript Variant: This variant (4) represents use of an alternate promoter and 5′ UTR, uses a distinct start codon, and lacks two alternate in-frame exons in the central coding region, compared to variant 1. The resulting isoform (4) has a shorter and distinct N-terminus and lacks an internal segment, compared to isoform 1. Publication Note: This RefSeq record includes a subset of the publications that are available for this gene. Please see the Gene record to access additional publications. |
| CHRNB3 | 463 | Both | Intronic | 1142 | neuronal acetylcholine receptor | The nicotinic acetylcholine receptors (nAChRs) are members of a superfamily of ligand-gated ion channels that mediate fast signal transmission at synapses. The nAChRs are (hetero)pentamers composed of homologous subunits. The subunits that |

TABLE 6-continued

| GENE NAME | Gene ID # | CNV type | CNV Gene Region | NCBI Gene ID | Gene Description | RefSeq Summary |
|---|---|---|---|---|---|---|
| | | | | | subunit beta-3 precursor | make up the muscle and neuronal forms of nAChRs are encoded by separate genes and have different primary structure. There are several subtypes of neuronal nAChRs that vary based on which homologous subunits are arranged around the central channel. They are classified as alpha-subunits if, like muscle alpha-1 (MIM 100690), they have a pair of adjacent cysteines as part of the presumed acetylcholine binding site. Subunits lacking these cysteine residues are classified as beta-subunits (Groot Kormelink and Luyten, 1997 [PubMed 9009220]). Elliott et al. (1996) [PubMed 8906617] stated that the proposed structure for each subunit is a conserved N-terminal extracellular domain followed by 3 conserved transmembrane domains, a variable cytoplasmic loop, a fourth conserved transmembrane domain, and a short C-terminal extracellular region. [supplied by OMIM, April 2010]. |
| CIB2 | 464 | Gain | Exonic | 10518 | calcium and integrin-binding family member 2 | The amino acid sequence the protein encoded by this gene is similar to that of KIP/CIB, calcineurin B, and calmodulin. This suggests that the encoded protein may be a Ca2+-binding regulatory protein that interacts with DNA-dependent protein kinase catalytic subunit (DNA-PKcs). [provided by RefSeq, July 2008]. |
| CLEC11A | 465 | Loss | Exonic | 6320 | C-type lectin domain family 11 member A precursor | This gene encodes a member of the C-type lectin superfamily. The encoded protein is a secreted sulfated glycoprotein and functions as a growth factor for primitive hematopoietic progenitor cells. An alternative splice variant has been described but its biological nature has not been determined. [provided by RefSeq, July 2008]. Publication Note: This RefSeq record includes a subset of the publications that are available for this gene. Please see the Gene record to access additional publications. |
| CNTNAP5 | 466 | Loss | Intronic | 129684 | contactin-associated protein-like 5 precursor | This gene product belongs to the neurexin family, members of which function in the vertebrate nervous system as cell adhesion molecules and receptors. This protein, like other neurexin proteins, contains epidermal growth factor repeats and laminin G domains. In addition, it includes an F5/8 type C domain, discoidin/neuropilin- and fibrinogen-like domains, and thrombospondin N-terminal-like domains. [provided by RefSeq, July 2008]. |
| COX6A1 | 467 | Gain | Exonic | 1337 | cytochrome c oxidase subunit 6A1, mitochondrial precursor | Cytochrome c oxidase (COX), the terminal enzyme of the mitochondrial respiratory chain, catalyzes the electron transfer from reduced cytochrome c to oxygen. It is a heteromeric complex consisting of 3 catalytic subunits encoded by mitochondrial genes and multiple structural subunits encoded by nuclear genes. The mitochondrially-encoded subunits function in the electron transfer and the nuclear-encoded subunits may function in the regulation and assembly of the complex. This nuclear gene encodes polypeptide 1 (liver isoform) of subunit VIa, and polypeptide 1 is found in all non-muscle tissues. Polypeptide 2 (heart/muscle isoform) of subunit VIa is encoded by a different gene, and is present only in striated muscles. These two polypeptides share 66% amino acid sequence identity. It has been reported that there may be several pseudogenes on chromosomes 1, 6, 7q21, 7q31-32 and 12. However, only one pseudogene (COX6A1P) on chromosome 1p31.1 has been documented. [provided by RefSeq, July 2008]. |
| CTNNA3 | 468 | Loss | Intronic | 29119 | catenin alpha-3 | N/A |
| CUTA | 469 | Loss | Exonic | 51596 | protein CutA isoform 3 precursor | N/A |
| DAPP1 | 470 | Gain | Exonic | 27071 | dual adapter for phosphotyrosine and 3-phosphotyrosine | N/A |

TABLE 6-continued

| GENE NAME | Gene ID # | CNV type | CNV Gene Region | NCBI Gene ID | Gene Description | RefSeq Summary |
|---|---|---|---|---|---|---|
| DHRSX | 471 | Both | Intronic | 207063 | and 3-phosphoinositide dehydrogenase/ reductase SDR family member on chromosome X precursor | N/A |
| DHRSX | 472 | Gain | Exonic | 207063 | dehydrogenase/ reductase SDR family member on chromosome X precursor | N/A |
| DIAPH2 | 473 | Loss | Intronic | 1730 | protein diaphanous homolog 2 isoform 12C | The product of this gene belongs to the diaphanous subfamily of the formin homology family of proteins. This gene may play a role in the development and normal function of the ovaries. Defects in this gene have been linked to premature ovarian failure 2. Alternatively spliced transcript variants encoding different isoforms have been identified. [provided by RefSeq, July 2008]. Transcript Variant: This variant (12C) differs in the 3' UTR and the 3' coding region, compared to variant 156. The resulting isoform (isoform 12C) contains a distinct C-terminus, compared to isoform 156. |
| DMD | 474 | Both | Intronic | 1756 | dystrophin Dp140c isoform | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp140 transcripts use exons 45-79, starting at a promoter/exon 1 located in intron 44. Dp140 transcripts have a long (1 kb) 5' UTR since translation is initiated in exon 51 (corresponding to aa 2461 of dystrophin). In addition to the alternative promoter and exon 1, differential splicing of exons 71-74 and 78 produces at least five Dp140 isoforms. Of these, this transcript (Dp140c) lacks exons 71-74. Sequence Note: This RefSeq record was created from transcript and genomic sequence data to make the sequence consistent with the reference genome assembly. The genomic coordinates used for the transcript record were based on transcript alignments. |
| DNER | 475 | Loss | Intronic | 92737 | delta and Notch-like epidermal growth factor-related receptor precursor | N/A |

TABLE 6-continued

| GENE NAME | Gene ID # | CNV type | CNV Gene Region | NCBI Gene ID | Gene Description | RefSeq Summmary |
|---|---|---|---|---|---|---|
| DPYD | 476 | Loss | Both | 1806 | dihydropyrimidine dehydrogenase [NADP+] isoform 1 | The protein encoded by this gene is a pyrimidine catabolic enzyme and the initial and rate-limiting factor in the pathway of uracil and thymidine catabolism. Mutations in this gene result in dihydropyrimidine dehydrogenase deficiency, an error in pyrimidine metabolism associated with thymine-uraciluria and an increased risk of toxicity in cancer patients receiving 5-fluorouracil chemotherapy. Two transcript variants encoding different isoforms have been found for this gene. [provided by RefSeq, May 2009]. Transcript Variant: This variant (1) represents the longer transcript and encodes the longer isoform (1). |
| EHD4 | 477 | Loss | Intronic | 30844 | EH domain-containing protein 4 | N/A |
| ERBB4 | 478 | Loss | Intronic | 2066 | receptor tyrosine-protein kinase erbB-4 isoform JM-a/CVT-2 precursor | This gene is a member of the Tyr protein kinase family and the epidermal growth factor receptor subfamily. It encodes a single-pass type I membrane protein with multiple cysteine rich domains, a transmembrane domain, a tyrosine kinase domain, a phosphotidylinositol-3 kinase binding site and a PDZ domain binding motif. The protein binds to and is activated by neuregulins and other factors and induces a variety of cellular responses including mitogenesis and differentiation. Multiple proteolytic events allow for the release of a cytoplasmic fragment and an extracellular fragment. Mutations in this gene have been associated with cancer. Alternatively spliced variants which encode different protein isoforms have been described; however, not all variants have been fully characterized. [provided by RefSeq, July 2008]. Transcript Variant: This variant (JM-a/CYT-2) lacks an alternate in-frame exon, compared to variant JM-a/CYT-1, resulting in a shorter protein (isoform JM-a/CYT-2) that lacks the phosphotidylinositol-3 kinase binding site, compared to isoform JM-a/CYT-1. |
| ERC1 | 479 | Both | Intronic | 23085 | ELKS/Rab6-interacting/CAST family member 1 isoform epsilon | The protein encoded by this gene is a member of a family of RIM-binding proteins. RIMs are active zone proteins that regulate neurotransmitter release. This gene has been found fused to the receptor-type tyrosine kinase gene RET by gene rearrangement due to the translocation t(10; 12)(q11; p13). Multiple transcript variants encoding different isoforms have been found for this gene. [provided by RefSeq, July 2008]. Transcript Variant: This variant (epsilon) encodes the longest isoform (epsilon). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| EYS | 480 | Loss | Intronic | 346007 | protein eyes shut homolog isoform 2 | The product of this gene contains multiple epidermal growth factor (EGF)-like and LamG domains. The protein is expressed in the photoreceptor layer of the retina, and the gene is mutated in autosomal recessive retinitis pigmentosa. Multiple transcript variants encoding different isoforms have been found for this gene. [provided by RefSeq, December 2008]. Transcript Variant: This variant (2) uses an alternate exon and 3' UTR, compared to variant 1. The resulting isoform (2) has a substantially shorter and unique C-terminus, compared to isoform 1. |
| FHIT | 481 | Loss | Both | 2272 | bis(5'-adenosyl)-triphosphatase | This gene, a member of the histidine triad gene family, encodes a diadenosine 5',5''-P1,P3-triphosphate hydrolase involved in purine metabolism. The gene encompasses the common fragile site FRA3B on chromosome 3, where carcinogen-induced damage can lead to translocations and aberrant transcripts of this gene. In fact, aberrant transcripts from this gene have been found in about half of all esophageal, stomach, and colon carcinomas. Alternatively spliced transcript variants have been found for this gene. [provided by RefSeq, October 2009]. Transcript Variant: This variant (2) has an alternate splice site in the 3' UTR, as compared to variant 1. Both variants 1 and 2 encode the same protein. |

TABLE 6-continued

| GENE NAME | Gene ID # | CNV type | CNV Gene Region | NCBI Gene ID | Gene Description | RefSeq Summmary |
|---|---|---|---|---|---|---|
| GALNT14 | 482 | Loss | Intronic | 79623 | polypeptide N-acetylgalactosaminyltransferase 14 | GALNT14 (EC 2.4.1.41) belongs to a large subfamily of glycosyltransferases residing in the Golgi apparatus. GALNT enzymes catalyze the first step in the O-glycosylation of mammalian proteins by transferring N-acetyl-D-galactosamine (GalNAc) to peptide substrates. [supplied by OMIM, April 2004]. |
| GATC | 483 | Gain | Exonic | 283459 | N/A | N/A |
| GPHN | 484 | Loss | Intronic | 10243 | gephyrin isoform 2 | This gene encodes a neuronal assembly protein that anchors inhibitory neurotransmitter receptors to the postsynaptic cytoskeleton via high affinity binding to a receptor subunit domain and tubulin dimers. In nonneuronal tissues, the encoded protein is also required for molybdenum cofactor biosynthesis. Mutations in this gene may be associated with the neurological condition hyperplexia and also lead to molybdenum cofactor deficiency. Numerous alternatively spliced transcript variants encoding different isoforms have been described; however, the full-length nature of all transcript variants is not currently known. [provided by RefSeq, July 2008]. Transcript Variant: This variant (2), also known as Geph2, lacks an alternate, in-frame exon, compared to variant 1. It encodes isoform 2, which is shorter than isoform 1. |
| GRID2 | 485 | Loss | Intronic | 2895 | glutamate receptor delta-2 subunit precursor | Human glutamate receptor delta-2 (GRID2) is a relatively new member of the family of ionotropic glutamate receptors which are the predominant excitatory neurotransmitter receptors in the mammalian brain. GRID2 is a predicted 1,007 amino acid protein that shares 97% identity with the mouse homolog which is expressed selectively in cerebellar Purkinje cells. A point mutation in mouse GRID2, associated with the phenotype named 'lurcher', in the heterozygous state leads to ataxia resulting from selective, cell-autonomous apoptosis of cerebellar Purkinje cells during postnatal development. Mice homozygous for this mutation die shortly after birth from massive loss of mid- and hindbrain neurons during late embryogenesis. This strongly suggests a role for GRID2 in neuronal apoptotic death. [provided by RefSeq, July 2008]. |
| GRM8 | 486 | Both | Intronic | 2918 | metabotropic glutamate receptor 8 isoform b precursor | L-glutamate is the major excitatory neurotransmitter in the central nervous system and activates both ionotropic and metabotropic glutamate receptors. Glutamatergic neurotransmission is involved in most aspects of normal brain function and can be perturbed in many neuropathologic conditions. The metabotropic glutamate receptors are a family of G protein-coupled receptors, that have been divided into 3 groups on the basis of sequence homology, putative signal transduction mechanisms, and pharmacologic properties. Group I includes GRM1 and GRM5 and these receptors have been shown to activate phospholipase C. Group II includes GRM2 and GRM3 while Group III includes GRM4, GRM6, GRM7 and GRM8. Group II and III receptors are linked to the inhibition of the cyclic AMP cascade but differ in their agonist selectivities. Alternatively spliced transcript variants encoding different isoforms have been described for this gene. [provided by RefSeq, July 2008]. Transcript Variant: This variant (2) uses an alternate donor splice site at the penultimate exon compared to transcript variant 1, resulting in an isoform (b) of the same length, but with 16 different amino acids at the C-terminus compared to isoform a. This variant was designated as HmGluR8b by Malherbe et al, 1999 (PMID: 10216218). |
| GRM8 | 487 | Gain | Exonic | 2918 | metabotropic glutamate receptor 8 isoform b precursor | L-glutamate is the major excitatory neurotransmitter in the central nervous system and activates both ionotropic and metabotropic glutamate receptors. Glutamatergic neurotransmission is involved in most aspects of normal brain function and can be perturbed in many neuropathologic conditions. The metabotropic glutamate receptors are a family of G protein-coupled receptors, that have been divided into 3 groups on the basis of sequence homology, putative signal transduction mechanisms, and pharmacologic properties. Group I includes GRM1 and GRM5 and these receptors have been shown to activate phospholipase C. Group II includes GRM2 and GRM3 while Group III includes GRM4, GRM6, GRM7 and GRM8. Group II and III receptors are linked to the inhibition of the cyclic AMP cascade but differ in their agonist |

TABLE 6-continued

| GENE NAME | Gene ID # | CNV type | CNV Gene Region | NCBI Gene ID | Gene Description | RefSeq Summary |
|---|---|---|---|---|---|---|
| | | | | | | selectivities. Alternatively spliced transcript variants encoding different isoforms have been described for this gene. [provided by RefSeq, July 2008]. Transcript Variant: This variant (2) uses an alternate donor splice site at the penultimate exon compared to transcript variant 1, resulting in an isoform (b) of the same length, but with 16 different amino acids at the C-terminus compared to isoform a. This variant was designated as HmGluR8b by Malherbe et al, 1999 (PMID: 10216218). |
| HECW1 | 488 | Loss | Intronic | 23072 | E3 ubiquitin-protein ligase HECW1 | N/A |
| HNRNPA2B1 | 489 | Gain | Exonic | 3181 | heterogeneous nuclear ribonucleoproteins A2/B1 isoform B1 | This gene belongs to the A/B subfamily of ubiquitously expressed heterogeneous nuclear ribonucleoproteins (hnRNPs). The hnRNPs are RNA binding proteins and they complex with heterogeneous nuclear RNA (hnRNA). These proteins are associated with pre-mRNAs in the nucleus and appear to influence pre-mRNA processing and other aspects of mRNA metabolism and transport. While all of the hnRNPs are present in the nucleus, some seem to shuttle between the nucleus and the cytoplasm. The hnRNP proteins have distinct nucleic acid binding properties. The protein encoded by this gene has two repeats of quasi-RRM domains that bind to RNAs. This gene has been described to generate two alternatively spliced transcript variants which encode different isoforms. [provided by RefSeq, July 2008]. Transcript Variant: This variant (B1) contains an additional 36 bases compared to variant A2. This additional region affects only the beginning of the coding region. The N-terminus of isoform B1 is thus different from isoform A2. |
| HSD17B12 | 490 | Loss | Exonic | 51144 | estradiol 17-beta-dehydrogenase 12 | This gene encodes a very important 17beta-hydroxysteroid dehydrogenase (17beta-HSD) that converts estrone into estradiol in ovarian tissue. This enzyme is also involved in fatty acid elongation. [provided by RefSeq, October 2011]. |
| IFNA22P | 491 | Gain | Exonic | 3453 | N/A | N/A |
| IL32 | 492 | Loss | Exonic | 9235 | interleukin-32 isoform D | This gene encodes a member of the cytokine family. The protein contains a tyrosine sulfation site, 3 potential N-myristoylation sites, multiple putative phosphorylation sites, and an RGD cell-attachment sequence. Expression of this protein is increased after the activation of T-cells by mitogens or the activation of NK cells by IL-2. This protein induces the production of TNFalpha from macrophage cells. Alternate transcriptional splice variants, encoding different isoforms, have been characterized. [provided by RefSeq, July 2008]. Transcript Variant: This variant (7) lacks two alternate exons in the 5' UTR and an alternate in-frame exon within the coding region, compared to variant 1, resulting in a shorter protein (isoform D). |
| JPH3 | 493 | Both | Intronic | 57338 | junctophilin-3 | Junctional complexes between the plasma membrane and endoplasmic/sarcoplasmic reticulum are a common feature of all excitable cell types and mediate cross talk between cell surface and intracellular ion channels. The protein encoded by this gene is a component of junctional complexes and is composed of a C-terminal hydrophobic segment spanning the endoplasmic/sarcoplasmic reticulum membrane and a remaining cytoplasmic domain that shows specific affinity for the plasma membrane. CAG/CTG repeat expansions at the Huntington's disease (HD)-like 2 locus have been identified in this gene, which is a member of the junctophilin gene family. [provided by RefSeq, July 2008]. Publication Note: This RefSeq record includes a subset of the publications that are available for this gene. Please see the Gene record to access additional publications. |
| KLHDC4 | 494 | Loss | Exonic | 54758 | kelch domain-containing protein 4 isoform 2 | N/A |

TABLE 6-continued

| GENE NAME | Gene ID # | CNV type | CNV Gene Region | NCBI Gene ID | Gene Description | RefSeq Summmary |
|---|---|---|---|---|---|---|
| LEP | 495 | Gain | Exonic | 3952 | leptin precursor | This gene encodes a protein that is secreted by white adipocytes, and which plays a major role in the regulation of body weight. This protein, which acts through the leptin receptor, functions as part of a signaling pathway that can inhibit food intake and/or regulate energy expenditure to maintain constancy of the adipose mass. This protein also has several endocrine functions, and is involved in the regulation of immune and inflammatory responses, hematopoiesis, angiogenesis and wound healing. Mutations in this gene and/or its regulatory regions cause severe obesity, and morbid obesity with hypogonadism. This gene has also been linked to type 2 diabetes mellitus development. [provided by RefSeq, July 2008]. Sequence Note: This RefSeq record was created from transcript and genomic sequence data to make the sequence consistent with the reference genome assembly. The genomic coordinates used for the transcript record were based on transcript alignments. |
| LOC255130 | 496 | Loss | Intronic | 255130 | N/A | N/A |
| LTBP4 | 497 | Loss | Exonic | 8425 | latent-transforming growth factor beta-binding protein 4 isoform b | The protein encoded by this gene binds transforming growth factor beta (TGFB) as it is secreted and targeted to the extracellular matrix. TGFB is biologically latent after secretion and insertion into the extracellular matrix, and sheds TGFB and other proteins upon activation. Defects in this gene may be a cause of cutis laxa and severe pulmonary, gastrointestinal, and urinary abnormalities. Three transcript variants encoding different isoforms have been found for this gene. [provided by RefSeq, May 2010]. Transcript Variant: This variant (2) differs in the 5' UTR and coding sequence compared to variant 1. The resulting isoform (b) has a shorter and distinct N-terminus compared to isoform a. |
| MCC | 498 | Loss | Both | 4163 | colorectal mutant cancer protein isoform 1 | This gene is a candidate colorectal tumor suppressor gene that is thought to negatively regulate cell cycle progression. The orthologous gene in the mouse expresses a phosphoprotein associated with the plasma membrane and membrane organelles, and overexpression of the mouse protein inhibits entry into S phase. Multiple transcript variants encoding different isoforms have been found for this gene. [provided by RefSeq, July 2008]. Transcript Variant: This variant (1) represents the longer transcript and encodes the longer isoform (1). Sequence Note: This RefSeq record was created from transcript and genomic sequence data because no single transcript was available for the full length of the gene. The extent of this transcript is supported by transcript alignments. Publication Note: This RefSeq record includes a subset of the publications that are available for this gene. Please see the Gene record to access additional publications. |
| MIR125A | 499 | Loss | Exonic | 406910 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. Publication Note: This RefSeq record includes a subset of the publications that are available for this gene. Please see the Gene record to access additional publications. |

TABLE 6-continued

| GENE NAME | Gene ID # | CNV type | CNV Gene Region | NCBI Gene ID | Gene Description | RefSeq Summary |
|---|---|---|---|---|---|---|
| MIR3910-1 | 500 | Loss | Exonic | 100500821 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR3910-2 | 501 | Loss | Exonic | 100500902 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR99B | 502 | Loss | Exonic | 407056 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIRLET7E | 503 | Loss | Exonic | 406887 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt |

TABLE 6-continued

| GENE NAME | Gene ID # | CNV type | CNV Gene Region | NCBI Gene ID | Gene Description | RefSeq Summary |
|---|---|---|---|---|---|---|
| | | | | | | stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MMP25 | 504 | Loss | Exonic | 64386 | matrix metalloproteinase-25 preproprotein | Proteins of the matrix metalloproteinase (MMP) family are involved in the breakdown of extracellular matrix in normal physiological processes, such as embryonic development, reproduction, and tissue remodeling, as well as in disease processes, such as arthritis and metastasis. Most MMPs are secreted as inactive proproteins which are activated when cleaved by extracellular proteinases. However, the protein encoded by this gene is a member of the membrane-type MMP (MT-MMP) subfamily, attached to the plasma membrane via a glycosylphosphatidyl inositol anchor. In response to bacterial infection or inflammation, the encoded protein is thought to inactivate alpha-1 proteinase inhibitor, a major tissue protectant against proteolytic enzymes released by activated neutrophils, facilitating the transendothelial migration of neutrophils to inflammatory sites. The encoded protein may also play a role in tumor invasion and metastasis through activation of MMP2. The gene has previously been referred to as MMP20 but has been renamed MMP25. [provided by RefSeq, July 2008]. |
| MPV17L2 | 505 | Gain | Exonic | 84769 | mpv17-like protein 2 precursor | N/A |
| MR1 | 506 | Loss | Exonic | 3140 | major histocompatibility complex class I-related gene protein isoform 4 precursor | N/A |
| MYH4 | 507 | Loss | Exonic | 4622 | myosin-4 | N/A |
| NAALAD2 | 508 | Loss | Exonic | 10003 | N-acetylated-alpha-linked acidic dipeptidase 2 | This gene is a member of the N-acetylated alpha-linked acidic dipeptidase (NAALADase) gene family. The representative member of this family is the gene encoding human prostate-specific membrane antigen (PSM), which is a marker of prostatic carcinomas and is the first to be shown to possess NAALADase activity. NAALADase cleaves N-acetyl-L-aspartyl-L-glutamate (NAAG), which is a neuropeptide expressed both in the central nervous systems and in the periphery and is thought to function as a neurotransmitter. The product of this gene is a type II integral membrane protein. Transient transfection of this gene confers both NAALADase and dipeptidyl peptidase IV activities to mammalian cells. This gene is highly expressed in ovary and testis as well as within discrete brain areas. [provided by RefSeq, July 2008]. |
| NACAD | 509 | Loss | Exonic | 23148 | NAC-alpha-domain-containing protein 1 | N/A |

TABLE 6-continued

| GENE NAME | Gene ID # | CNV type | CNV Gene Region | NCBI Gene ID | Gene Description | RefSeq Summary |
|---|---|---|---|---|---|---|
| NCKAP5 | 510 | Both | Exonic | 344148 | nck-associated protein 5 isoform 2 | N/A |
| NCRNA00085 | 511 | Loss | Exonic | N/A | N/A | N/A |
| NDST3 | 512 | Loss | Intronic | 9348 | bifunctional heparan sulfate N-deacetylase/N-sulfotransferase 3 | This gene encodes a member of the heparan sulfate/heparin GlcNAc N-deacetylase/N-sulfotransferase family. The encoded enzyme is a type II transmembrane protein that resides in the Golgi apparatus. This monomeric bifunctional enzyme catalyzes the N-deacetylation and N-sulfation of N-acetylglucosamine residues in heparan sulfate and heparin, which are the initial chemical modifications required for the biosynthesis of the functional oligosaccharide sequences that define the specific ligand binding activities of heparan sulfate and heparin. [provided by RefSeq, November 2008]. |
| NFE2L3 | 513 | Gain | Exonic | 9603 | nuclear factor erythroid 2-related factor 3 | This gene encodes a member of the cap 'n' collar basic-region leucine zipper family of transcription factors. The encoded protein heterodimerizes with small musculoaponeurotic fibrosarcoma factors to bind antioxidant response elements in target genes. This protein is a membrane bound glycoprotein that is targeted to the endoplasmic reticulum and the nuclear envelope. Pseudogenes of this gene are found on chromosomes 16, 17, and 18. [provided by RefSeq, March 2009]. |
| NOTCH2NL | 514 | Gain | Exonic | 388677 | notch homolog 2 N-terminal-like protein | N/A |
| NRXN1 | 515 | Loss | Both | 9378 | neurexin-1-beta isoform beta precursor | Neurexins function in the vertebrate nervous system as cell adhesion molecules and receptors. Two neurexin genes are among the largest known in human (NRXN1 and NRXN3). By using alternate promoters, splice sites and exons, predictions of hundreds or even thousands of distinct mRNAs have been made. Most transcripts use the upstream promoter and encode alpha-neurexin isoforms; fewer transcripts are produced from the downstream promoter and encode beta-neurexin isoforms. Alpha-neurexins contain epidermal growth factor-like (EGF-like) sequences and laminin G domains, and they interact with neurexophilins. Beta-neurexins lack EGF-like sequences and contain fewer laminin G domains than alpha-neurexins. The RefSeq Project has decided to create only a few representative transcript variants of the multitude that are possible. [provided by RefSeq, October 2008]. Transcript Variant: This variant (beta) represents a beta neurexin transcript. It is transcribed from a downstream promoter, includes a different segment for its 5′ UTR and 5′ coding region, and lacks most of the 5′ exons present in alpha transcripts, as compared to variant alpha2. The resulting protein (isoform beta) has a shorter and distinct N-terminus when it is compared to isoform alpha2. Sequence Note: The RefSeq transcript and protein were derived from transcript and genomic sequence to make the sequence consistent with the reference genome assembly. The genomic coordinates used for the transcript record were based on alignments. |
| NRXN3 | 516 | Loss | Both | 9369 | neurexin-3-beta isoform 3 precursor | Neurexins are a family of proteins that function in the vertebrate nervous system as cell adhesion molecules and receptors. They are encoded by several unlinked genes of which two, NRXN1 and NRXN3, are among the largest known human genes. Three of the genes (NRXN1-3) utilize two alternate promoters and include numerous alternatively spliced exons to generate thousands of distinct mRNA transcripts and protein isoforms. The majority of transcripts are produced from the upstream promoter and encode alpha-neurexin isoforms; a much smaller number of transcripts are produced from the downstream promoter and encode beta-neurexin isoforms. The alpha-neurexins contain epidermal growth factor-like (EGF-like) sequences and laminin G domains, and have been shown to interact with neurexophilins. The beta- |

TABLE 6-continued

| GENE NAME | Gene ID # | CNV type | CNV Gene Region | NCBI Gene ID | Gene Description | RefSeq Summary |
|---|---|---|---|---|---|---|
| OR2V2 | 517 | Gain | Exonic | 285659 | olfactory receptor 2V2 | neurexins lack EGF-like sequences and contain fewer laminin G domains than alpha-neurexins. [provided by RefSeq, July 2008]. Transcript Variant: This variant (3) differs in the 5' UTR and has multiple coding region differences, compared to variant 1. The resulting isoform (3) has a shorter and distinct N-terminus when compared to isoform 1. Publication Note: This RefSeq record includes a subset of the publications that are available for this gene. Please see the Gene record to access additional publications. Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| PANK2 | 518 | Loss | Intronic | 80025 | pantothenate kinase 2, mitochondria 1 isoform 2 | This gene encodes a protein belonging to the pantothenate kinase family and is the only member of that family to be expressed in mitochondria. Pantothenate kinase is a key regulatory enzyme in the biosynthesis of coenzyme A (CoA) in bacteria and mammalian cells. It catalyzes the first committed step in the universal biosynthetic pathway leading to CoA and is itself subject to regulation through feedback inhibition by acyl CoA species. Mutations in this gene are associated with HARP syndrome and pantothenate kinase-associated neurodegeneration (PKAN), formerly Hallervorden-Spatz syndrome. Alternative splicing, involving the use of alternate first exons, results in multiple transcripts encoding different isoforms. [provided by RefSeq, July 2008]. Transcript Variant: This variant (2) has an alternate first exon, and uses a downstream translation initiation site, compared to variant 1. The resulting protein (isoform 2) lacks an N-terminal segment compared to isoform 1, resulting in a shorter protein that shares identity through the C-terminus. Isoform 2 is not expressed in mitochondria. Variants 2 and 3 encode isoform 2. |
| PHF1 | 519 | Loss | Exonic | 5252 | PHD finger protein 1 isoform a | This gene encodes a Polycomb group protein. The protein is a component of a histone H3 lysine-27 (H3K27)-specific methyltransferase complex, and functions in transcriptional repression of homeotic genes. The protein is also recruited to double-strand breaks, and reduced protein levels results in X-ray sensitivity and increased homologous recombination. Multiple transcript variants encoding different isoforms have been found for this gene. [provided by RefSeq, May 2009]. Transcript Variant: This variant (1), uses an alternate splice site and lacks an alternate exon in the 3' coding region resulting in a frameshift, compared to variant 2. The resulting isoform (a) has a shorter and distinct C-terminus, compared to isoform b. |
| PLXNA4 | 520 | Both | Exonic | 91584 | plexin-A4 isoform 1 precursor | N/A |
| POT1 | 521 | Gain | Exonic | 25913 | protection of telomeres protein 1 isoform 1 | This gene is a member of the telombin family and encodes a nuclear protein involved in telomere maintenance. Specifically, this protein functions as a member of a multi-protein complex that binds to the TTAGGG repeats of telomeres, regulating telomere length and protecting chromosome ends from illegitimate recombination, catastrophic chromosome instability, and abnormal chromosome segregation. Increased transcriptional expression of this gene is associated with stomach carcinogenesis and its progression. Alternatively spliced transcript variants have been described. [provided by RefSeq, July 2008]. Transcript Variant: This variant (1) encodes the longer isoform (1). |

TABLE 6-continued

| GENE NAME | Gene ID # | CNV type | CNV Gene Region | NCBI Gene ID | Gene Description | RefSeq Summary |
|---|---|---|---|---|---|---|
| PPP2R2B | 522 | Loss | Intronic | 5521 | serine/threonine-protein phosphatase 2A 55 kDa regulatory subunit B beta isoform a | The product of this gene belongs to the phosphatase 2 regulatory subunit B family. Protein phosphatase 2 is one of the four major Ser/Thr phosphatases, and it is implicated in the negative control of cell growth and division. It consists of a common heteromeric core enzyme, which is composed of a catalytic subunit and a constant regulatory subunit, that associates with a variety of regulatory subunits. The B regulatory subunit might modulate substrate selectivity and catalytic activity. This gene encodes a beta isoform of the regulatory subunit B55 subfamily. Defects in this gene cause autosomal dominant spinocerebellar ataxia 12 (SCA12), a disease caused by degeneration of the cerebellum, sometimes involving the brainstem and spinal cord, and in resulting in poor coordination of speech and body movements. Multiple alternatively spliced variants, which encode different isoforms, have been identified for this gene. The 5' UTR of some of these variants includes a CAG trinucleotide repeat sequence (7-28 copies) that can be expanded to 66-78 copies in cases of SCA12. [provided by RefSeq, July 2008]. Transcript Variant: This variant (7) differs in the 5' UTR, which includes a trinucleotide repeat region, compared to variant 1. Transcript variants 1, 2, 3 and 7 encode the same isoform (a). |
| PRSS2 | 523 | Loss | Exonic | 5645 | trypsin-2 preproprotein | This gene encodes a trypsinogen, which is a member of the trypsin family of serine proteases. This enzyme is secreted by the pancreas and cleaved to its active form in the small intestine. It is active on peptide linkages involving the carboxyl group of lysine or arginine. This gene and several other trypsinogen genes are localized to the T cell receptor beta locus on chromosome 7. [provided by RefSeq, July 2008]. |
| PTPRN2 | 524 | Both | Intronic | 5799 | receptor-type tyrosine-protein phosphatase N2 isoform 3 precursor | The protein encoded by this gene is a member of the protein tyrosine phosphatase (PTP) family. PTPs are known to be signaling molecules that regulate a variety of cellular processes including cell growth, differentiation, mitotic cycle, and oncogenic transformation. This PTP possesses an extracellular region, a single transmembrane region, and a single intracellular catalytic domain, and thus represents a receptor-type PTP. The catalytic domain of this PTP is most closely related to PTPRN/IA-2beta. This PTP and PTPRN are both found to be major autoantigens associated with insulin-dependent diabetes mellitus. Three alternatively spliced transcript variants of this gene, which encode distinct proteins, have been reported. [provided by RefSeq, July 2008]. Transcript Variant: This variant (3) lacks an internal fragment within the coding region when compared to variant 1. The translation remains in-frame, and thus results in a protein that lacks a 29 aa internal segment, as compared to isoform (1). |
| RAB3A | 525 | Gain | Exonic | 5864 | ras-related protein Rab-3A | N/A |
| RERE | 526 | Both | Intronic | 473 | arginine-glutamic acid dipeptide repeats protein isoform b | This gene encodes a member of the atrophin family of arginine-glutamic acid (RE) dipeptide repeat-containing proteins. The encoded protein co-localizes with a transcription factor in the nucleus, and its overexpression triggers apoptosis. A similar protein in mouse associates with histone deacetylase and is thought to function as a transcriptional co-repressor during embryonic development. Multiple transcript variants encoding different isoforms have been found for this gene. [provided by RefSeq, July 2008]. Transcript Variant: This variant (3) contains a distinct 5' UTR and lacks an in-frame portion of the 5' coding region, compared to variant 1. The resulting isoform (b) has a shorter N-terminus when compared to isoform a. |
| RGS7 | 527 | Loss | Intronic | 6000 | regulator of G-protein signaling 7 | N/A |
| ROBO2 | 528 | Loss | Intronic | 6092 | roundabout homolog 2 isoform | This gene belongs to the ROBO family, part of the immunoglobulin superfamily proteins that are highly conserved from fly to human. The encoded protein is a receptor for SLIT2, molecules known to function in axon guidance and cell migration. Defects |

TABLE 6-continued

| GENE NAME | Gene ID # | CNV type | CNV Gene Region | NCBI Gene ID | Gene Description | RefSeq Summary |
|---|---|---|---|---|---|---|
|  |  |  |  |  | ROBO2a | in this gene are the cause of vesicoureteral reflux type 2. Alternatively spliced transcript variants encoding different isoforms have been described for this gene. [provided by RefSeq, July 2008]. Transcript Variant: This variant (1) encodes the longer protein (isoform ROBO2a). Sequence Note: This RefSeq record was created from transcript and genomic sequence data to make the sequence consistent with the reference genome assembly. The genomic coordinates used for the transcript record were based on transcript alignments. |
| SAE1 | 529 | Gain | Exonic | 10055 | SUMO-activating enzyme subunit 1 isoform b | Posttranslational modification of proteins by the addition of the small protein SUMO (see SUMO1; MIM 601912), or sumoylation, regulates protein structure and intracellular localization. SAE1 and UBA2 (MIM 613295) form a heterodimer that functions as a SUMO-activating enzyme for the sumoylation of proteins (Okuma et al., 1999 [PubMed 9920803]). [supplied by OMIM, March 2010]. Transcript Variant: This variant (2) lacks one alternate exons, compared to variant 1, which causes a frameshift. The resulting protein (isoform b) has a distinct C-terminus and is shorter than isoform a. |
| SBF2 | 530 | Loss | Intronic | 81846 | myotubularin-related protein 13 | This gene encodes a pseudophosphatase and member of the myotubularin-related protein family. This gene maps within the CMT4B2 candidate region of chromosome 11p15 and mutations in this gene have been associated with Charcot-Marie-Tooth Disease, type 4B2. [provided by RefSeq, July 2008]. Publication Note: This RefSeq record includes a subset of the publications that are available for this gene. Please see the Gene record to access additional publications. |
| SEC22B | 531 | Gain | Exonic | 9554 | vesicle-trafficking protein SEC22b precursor | The protein encoded by this gene is a member of the SEC22 family of vesicle trafficking proteins. It seems to complex with SNARE and it is thought to play a role in the ER-Golgi protein trafficking This protein has strong similarity to *Mus musculus* and *Cricetulus griseus* proteins. [provided by RefSeq, September 2009]. |
| SHKBP1 | 532 | Loss | Exonic | 92799 | SH3KBP1-binding protein 1 | N/A |
| SPTBN4 | 533 | Loss | Exonic | 57731 | spectrin beta chain, brain 3 isoform signal | Spectrin is an actin crosslinking and molecular scaffold protein that links the plasma membrane to the actin cytoskeleton, and functions in the determination of cell shape, arrangement of transmembrane proteins, and organization of organelles. It is composed of two antiparallel dimers of alpha- and beta-subunits. This gene is one member of a family of beta-spectrin genes. The encoded protein localizes to the nuclear matrix, PML nuclear bodies, and cytoplasmic vesicles. A highly similar gene in the mouse is required for localization of specific membrane proteins in polarized regions of neurons. Multiple transcript variants encoding different isoforms have been found for this gene. [provided by RefSeq, July 2008]. Transcript Variant: This variant (signal) represents the longer transcript and encodes the longer isoform (signal), also known as the 289 kDa isoform. |
| STX6 | 534 | Loss | Exonic | 10228 | syntaxin-6 | N/A |
| SYAP1 | 535 | Gain | Exonic | 94056 | N/A | N/A |
| SYNGAP1 | 536 | Loss | Exonic | 8831 | ras GTPase-activating protein SynGAP | The protein encoded by this gene is a major component of the postsynaptic density (PSD), a group of proteins found associated with NMDA receptors at synapses. The encoded protein is phosphorylated by calmodulin-dependent protein kinase II and dephosphorylated by NMDA receptor activation. Defects in this gene are a cause of mental retardation autosomal dominant type 5 (MRD5). [provided by RefSeq, December 2009]. Publication Note: This RefSeq record includes a subset of the publications that are available for this gene. Please see the Gene record to access additional publications. |
| TM4SF5 | 537 | Loss | Exonic | 9032 | transmembrane 4 L6 | The protein encoded by this gene is a member of the transmembrane 4 superfamily, also known as the tetraspanin family. Most of these members are cell-surface proteins |

TABLE 6-continued

| GENE NAME | Gene ID # | CNV type | CNV Gene Region | NCBI Gene ID | Gene Description | RefSeq Summmary |
|---|---|---|---|---|---|---|
| | | | | | family member 5 precursor | that are characterized by the presence of four hydrophobic domains. The proteins mediate signal transduction events that play a role in the regulation of cell development, activation, growth and motility. This encoded protein is a cell surface glycoprotein and is highly similar in sequence and structure to transmembrane 4 superfamily member 1. It may play a role in cell proliferation, and overexpression of this protein may be associated with the uncontrolled growth of tumour cells. [provided by RefSeq, July 2008]. |
| TRAF3IP1 | 538 | Gain | Intronic | 26146 | TRAF3-interacting protein 1 isoform 2 | N/A |
| TRIAP1 | 539 | Gain | Exonic | 51499 | TP53-regulated inhibitor of apoptosis 1 | N/A |
| TRIB3 | 540 | Loss | Exonic | 57761 | tribbles homolog 3 | The protein encoded by this gene is a putative protein kinase that is induced by the transcription factor NF-kappaB. The encoded protein is a negative regulator of NF-kappaB and can also sensitize cells to TNF- and TRAIL-induced apoptosis. In addition, this protein can negatively regulate the cell survival serine-threonine kinase AKT1. [provided by RefSeq, July 2008]. |
| UBE4B | 541 | Loss | Intronic | 10277 | ubiquitin conjugation factor E4 B isoform 2 | The modification of proteins with ubiquitin is an important cellular mechanism for targeting abnormal or short-lived proteins for degradation. Ubiquitination involves at least three classes of enzymes: ubiquitin-activating enzymes, or E1s, ubiquitin-conjugating enzymes, or E2s, and ubiquitin-protein ligases, or E3s. This gene encodes an additional conjugation factor, E4, which is involved in multiubiquitin chain assembly. This gene is also the strongest candidate in the neuroblastoma tumor suppressor genes. Alternatively spliced transcript variants encoding distinct isoforms have been found for this gene. [provided by RefSeq, July 2008]. Transcript Variant: This variant (2) lacks an in-frame coding exon in the middle region of the CDS, and thus encodes a shorter isoform (2), as compared to variant 1. |
| WDR25 | 542 | Loss | Intronic | 79446 | WD repeat-containing protein 25 | N/A |
| YWHAE | 543 | Gain | Exonic | 7531 | 14-3-3 protein epsilon | This gene product belongs to the 14-3-3 family of proteins which mediate signal transduction by binding to phosphoserine-containing proteins. This highly conserved protein family is found in both plants and mammals, and this protein is 100% identical to the mouse ortholog. It interacts with CDC25 phosphatases, RAF1 and IRS1 proteins, suggesting its role in diverse biochemical activities related to signal transduction, such as cell division and regulation of insulin sensitivity. It has also been implicated in the pathogenesis of small cell lung cancer. Two transcript variants, one protein-coding and the other non-protein-coding, have been found for this gene. [provided by RefSeq, August 2008]. Transcript Variant: This variant (1) represents the protein-coding transcript. |
| ZFAND3 | 544 | Gain | Intronic | 60685 | AN1-type zinc finger protein 3 | N/A |
| ZNF517 | 545 | Loss | Exonic | 340385 | zinc finger protein 517 | N/A |

Table 6 represents a non-redundant list of genes for all genes listed in Table 5. Column 1 refers to the gene name using the RefSeq Gene Symbol nomenclature. CNV classifications of gain or loss in column 2 indicate whether each CNV region found in the subjects was duplicated/amplified (gain) or deleted (loss) in the genome. Column 3 refers to whether the CNV Gene Region is intronic, exonic or both. "Intronic" refers to CNVs affecting introns only; "Exonic" refers to CNVs affecting part or all of one or more exons, which may include adjacent intronic regions if the CNV extends beyond the exonic region. Column 4 refers to the DNA Accession number associated with each respective gene. Column 5 lists the full gene name and column 6 refers to a summary of each respective gene's function.

TABLE 7

| SEQ ID | RefSeq Gene Symbol | CNV Gene Region | CNV Type | RefSeq Accession Number | RefSeq Gene Description/Definition (transcript variant = tv; HS = HS) |
|---|---|---|---|---|---|
| SEQ ID 2558 | RERE | intronic | Both | NM_012102 | HS arginine-glutamic acid dipeptide (RE) repeats (RERE), tv1, mRNA. |
| SEQ ID 2559 | RERE | intronic | Both | NM_001042681 | HS arginine-glutamic acid dipeptide (RE) repeats (RERE), tv2, mRNA. |
| SEQ ID 2560 | UBE4B | intronic | Loss | NM_006048 | HS ubiquitination factor E4B (UBE4B), tv2, mRNA. |
| SEQ ID 2561 | UBE4B | intronic | Loss | NM_001105562 | HS ubiquitination factor E4B (UBE4B), tv1, mRNA. |
| SEQ ID 2562 | DPYD | both | Loss | NM_000110 | HS dihydropyrimidine dehydrogenase (DPYD), tv1, mRNA. |
| SEQ ID 2563 | SEC22B | exonic | Gain | NM_004892 | HS SEC22 vesicle trafficking protein homolog B (*S. cerevisiae*) (gene/pseudogene) (SEC22B), mRNA. |
| SEQ ID 2564 | NOTCH2NL | exonic | Gain | NM_203458 | HS notch 2 N-terminal like (NOTCH2NL), mRNA. |
| SEQ ID 2565 | STX6 | exonic | Loss | NM_005819 | HS syntaxin 6 (STX6), mRNA. |
| SEQ ID 2566 | MR1 | exonic | Loss | NM_001195000 | HS major histocompatibility complex, class I-related (MR1), tv3, mRNA. |
| SEQ ID 2567 | MR1 | exonic | Loss | NM_001195035 | HS major histocompatibility complex, class I-related (MR1), tv4, mRNA. |
| SEQ ID 2568 | MR1 | exonic | Loss | NM_001194999 | HS major histocompatibility complex, class I-related (MR1), tv2, mRNA. |
| SEQ ID 2569 | MR1 | exonic | Loss | NM_001531 | HS major histocompatibility complex, class I-related (MR1), tv1, mRNA. |
| SEQ ID 2570 | RGS7 | intronic | Loss | NM_002924 | HS regulator of G-protein signaling 7 (RGS7), mRNA. |
| SEQ ID 2571 | GALNT14 | intronic | Loss | NM_024572 | HS UDP-N-acetyl-alpha-D-galactosamine:polypeptide N-acetylgalactosaminyltransferase 14 (GalNAc-T14) (GALNT14), tv1, mRNA. |
| SEQ ID 2572 | GALNT14 | intronic | Loss | NR_045602 | HS UDP-N-acetyl-alpha-D-galactosamine:polypeptide N-acetylgalactosaminyltransferase 14 (GalNAc-T14) (GALNT14), tv4, non-coding RNA. |
| SEQ ID 2573 | GALNT14 | intronic | Loss | NM_001253827 | HS UDP-N-acetyl-alpha-D-galactosamine:polypeptide N-acetylgalactosaminyltransferase 14 (GalNAc-T14) (GALNT14), tv3, mRNA. |
| SEQ ID 2574 | GALNT14 | intronic | Loss | NM_001253826 | HS UDP-N-acetyl-alpha-D-galactosamine:polypeptide N-acetylgalactosaminyltransferase 14 (GalNAc-T14) (GALNT14), tv2, mRNA. |
| SEQ ID 2575 | NRXN1 | both | Loss | NM_004801 | HS neurexin 1 (NRXN1), tvalpha1, mRNA. |
| SEQ ID 2576 | NRXN1 | both | Loss | NM_001135659 | HS neurexin 1 (NRXN1), tvalpha2, mRNA. |
| SEQ ID 2577 | CNTNAP5 | intronic | Loss | NM_130773 | HS contactin associated protein-like 5 (CNTNAP5), mRNA. |
| SEQ ID 2578 | NCKAP5 | both | Both | NM_207363 | HS NCK-associated protein 5 (NCKAP5), tv1, mRNA. |
| SEQ ID 2579 | NCKAP5 | both | Both | NM_207481 | HS NCK-associated protein 5 (NCKAP5), tv2, mRNA. |
| SEQ ID 2580 | ARHGAP15 | exonic | Both | NM_018460 | HS Rho GTPase activating protein 15 (ARHGAP15), mRNA. |
| SEQ ID 2581 | CALCRL | intronic | Loss | NM_005795 | HS calcitonin receptor-like (CALCRL), tv1, mRNA. |
| SEQ ID 2582 | ERBB4 | intronic | Loss | NM_005235 | HS v-erb-a erythroblastic leukemia viral oncogene homolog 4 (avian) (ERBB4), tvJM-a/CVT-1, mRNA. |
| SEQ ID 2583 | ERBB4 | intronic | Loss | NM_001042599 | HS v-erb-a erythroblastic leukemia viral oncogene homolog 4 (avian) (ERBB4), tvJM-a/CVT-2, mRNA. |
| SEQ ID 2584 | DNER | intronic | Loss | NM_139072 | HS delta/notch-like EGF repeat containing (DNER), mRNA. |
| SEQ ID 2585 | TRAF3IP1 | intronic | Gain | NM_001139490 | HS TNF receptor-associated factor 3 interacting protein 1 (TRAF3IP1), tv2, mRNA. |
| SEQ ID 2586 | TRAF3IP1 | intronic | Gain | NM_015650 | HS TNF receptor-associated factor 3 interacting protein 1 (TRAF3IP1), tv1, mRNA. |
| SEQ ID 2587 | FHIT | both | Loss | NM_001166243 | HS fragile histidine triad (FHIT), tv2, mRNA. |
| SEQ ID 2588 | FHIT | both | Loss | NM_002012 | HS fragile histidine triad (FHIT), tv1, mRNA. |
| SEQ ID 2589 | ROBO2 | intronic | Loss | NM_001128929 | HS roundabout, axon guidance receptor, homolog 2 (*Drosophila*) (ROBO2), tv1, mRNA. |
| SEQ ID 2590 | ROBO2 | intronic | Loss | NM_002942 | HS roundabout, axon guidance receptor, homolog 2 (*Drosophila*) (ROBO2), tv2, mRNA. |
| SEQ ID 2591 | LOC255130 | intronic | Loss | NR_034081 | HS uncharacterized LOC255130 (LOC255130), non-coding RNA. |
| SEQ ID 2592 | ANTXR2 | intronic | Gain | NM_058172 | HS anthrax toxin receptor 2 (ANTXR2), tv1, mRNA. |
| SEQ ID 2593 | GRID2 | intronic | Loss | NM_001510 | HS glutamate receptor, ionotropic, delta 2 (GRID2), mRNA. |
| SEQ ID 2594 | DAPP1 | exonic | Gain | NM_014395 | HS dual adaptor of phosphotyrosine and 3-phosphoinositides (DAPP1), mRNA. |
| SEQ ID 2595 | NDST3 | intronic | Loss | NM_004784 | HS N-deacetylase/N-sulfotransferase (heparan glucosaminyl) 3 (NDST3), mRNA. |
| SEQ ID 2596 | BHMT2 | exonic | Gain | NM_001178005 | HS betaine--homocysteine S-methyltransferase 2 (BHMT2), tv2, mRNA. |
| SEQ ID 2597 | BHMT2 | exonic | Gain | NM_017614 | HS betaine--homocysteine S-methyltransferase 2 (BHMT2), tv1, mRNA. |
| SEQ ID 2598 | MCC | both | Loss | NM_002387 | HS mutated in colorectal cancers (MCC), tv2, mRNA. |
| SEQ ID 2599 | MCC | both | Loss | NM_001085377 | HS mutated in colorectal cancers (MCC), tv1, mRNA. |
| SEQ ID 2600 | PPP2R2B | intronic | Loss | NM_181677 | HS protein phosphatase 2, regulatory subunit B, beta (PPP2R2B), tv5, mRNA. |
| SEQ ID 2601 | PPP2R2B | intronic | Loss | NM_181676 | HS protein phosphatase 2, regulatory subunit B, beta (PPP2R2B), tv4, mRNA. |
| SEQ ID 2602 | PPP2R2B | intronic | Loss | NM_181678 | HS protein phosphatase 2, regulatory subunit B, beta (PPP2R2B), tv6, mRNA. |
| SEQ ID 2603 | PPP2R2B | intronic | Loss | NM_181674 | HS protein phosphatase 2, regulatory subunit B, beta (PPP2R2B), tv2, mRNA. |
| SEQ ID 2604 | OR2V2 | exonic | Gain | NM_206880 | HS olfactory receptor, family 2, subfamily V, member 2 (OR2V2), mRNA. |
| SEQ ID 2605 | SYNGAP1 | exonic | Loss | NM_006772 | HS synaptic Ras GTPase activating protein 1 (SYNGAP1), mRNA. |

TABLE 7-continued

| SEQ ID | RefSeq Gene Symbol | CNV Gene Region | CNV Type | RefSeq Accession Number | RefSeq Gene Description/Definition (transcript variant = tv; HS = HS) |
|---|---|---|---|---|---|
| SEQ ID 2606 | CUTA | exonic | Loss | NM_001014433 | HS cutA divalent cation tolerance homolog (*E. coli*) (CUTA), tv1, mRNA. |
| SEQ ID 2607 | PHF1 | exonic | Loss | NR_027692 | HS PHD finger protein 1 (PHF1), tv3, non-coding RNA. |
| SEQ ID 2608 | PHF1 | exonic | Loss | NM_024165 | HS PHD finger protein 1 (PHF1), tv2, mRNA. |
| SEQ ID 2609 | PHF1 | exonic | Loss | NM_002636 | HS PHD finger protein 1 (PHF1), tv1, mRNA. |
| SEQ ID 2610 | CUTA | exonic | Loss | NM_001014840 | HS cutA divalent cation tolerance homolog (*E. coli*) (CUTA), tv5, mRNA. |
| SEQ ID 2611 | CUTA | exonic | Loss | NM_001014838 | HS cutA divalent cation tolerance homolog (*E. coli*) (CUTA), tv4, mRNA. |
| SEQ ID 2612 | CUTA | exonic | Loss | NM_001014837 | HS cutA divalent cation tolerance homolog (*E. coli*) (CUTA), tv3, mRNA. |
| SEQ ID 2613 | CUTA | exonic | Loss | NM_015921 | HS cutA divalent cation tolerance homolog (*E. coli*) (CUTA), tv2, mRNA. |
| SEQ ID 2614 | ZFAND3 | intronic | Gain | NM_021943 | HS zinc finger, AN1-type domain 3 (ZFAND3), mRNA. |
| SEQ ID 2615 | EYS | intronic | Loss | NM_001142800 | HS eyes shut homolog (*Drosophila*) (EYS), tv1, mRNA. |
| SEQ ID 2616 | EYS | intronic | Loss | NM_198283 | HS eyes shut homolog (*Drosophila*) (EYS), tv3, mRNA. |
| SEQ ID 2617 | EYS | intronic | Loss | NM_001142801 | HS eyes shut homolog (*Drosophila*) (EYS), tv2, mRNA. |
| SEQ ID 2618 | NFE2L3 | exonic | Gain | NM_004289 | HS nuclear factor (erythroid-derived 2)-like 3 (NFE2L3), mRNA. |
| SEQ ID 2619 | HNRNPA2B1 | exonic | Gain | NM_031243 | HS heterogeneous nuclear ribonucleoprotein A2/B1 (HNRNPA2B1), tvB1, mRNA. |
| SEQ ID 2620 | HNRNPA2B1 | exonic | Gain | NM_002137 | HS heterogeneous nuclear ribonucleoprotein A2/B1 (HNRNPA2B1), tvA2, mRNA. |
| SEQ ID 2621 | HECW1 | intronic | Loss | NM_015052 | HS HECT, C2 and WW domain containing E3 ubiquitin protein ligase 1 (HECW1), mRNA. |
| SEQ ID 2622 | NACAD | exonic | Loss | NM_001146334 | HS NAC alpha domain containing (NACAD), mRNA. |
| SEQ ID 2623 | CCM2 | exonic | Loss | NR_030770 | HS cerebral cavernous malformation 2 (CCM2), tv5, non-coding RNA. |
| SEQ ID 2624 | CCM2 | exonic | Loss | NM_031443 | HS cerebral cavernous malformation 2 (CCM2), tv2, mRNA. |
| SEQ ID 2625 | CCM2 | exonic | Loss | NM_001167935 | HS cerebral cavernous malformation 2 (CCM2), tv4, mRNA. |
| SEQ ID 2626 | CCM2 | exonic | Loss | NM_001167934 | HS cerebral cavernous malformation 2 (CCM2), tv3, mRNA. |
| SEQ ID 2627 | CCM2 | exonic | Loss | NM_001029835 | HS cerebral cavernous malformation 2 (CCM2), tv1, mRNA. |
| SEQ ID 2628 | POT1 | exonic | Gain | NR_003103 | HS protection of telomeres 1 (POT1), tv3, non-coding RNA. |
| SEQ ID 2629 | POT1 | exonic | Gain | NM_015450 | HS protection of telomeres 1 (POT1), tv1, mRNA. |
| SEQ ID 2630 | POT1 | exonic | Gain | NM_001042594 | HS protection of telomeres 1 (POT1), tv4, mRNA. |
| SEQ ID 2631 | POT1 | exonic | Gain | NR_003104 | HS protection of telomeres 1 (POT1), tv5, non-coding RNA. |
| SEQ ID 2632 | POT1 | exonic | Gain | NR_003102 | HS protection of telomeres 1 (POT1), tv2, non-coding RNA. |
| SEQ ID 2633 | GRM8 | both | Both | NM_000845 | HS glutamate receptor, metabotropic 8 (GRM8), tv1, mRNA. |
| SEQ ID 2634 | GRM8 | both | Both | NR_028041 | HS glutamate receptor, metabotropic 8 (GRM8), tv3, non-coding RNA. |
| SEQ ID 2635 | GRM8 | both | Both | NM_001127323 | HS glutamate receptor, metabotropic 8 (GRM8), tv2, mRNA. |
| SEQ ID 2636 | LEP | exonic | Gain | NM_000230 | HS leptin (LEP), mRNA. |
| SEQ ID 2637 | PLXNA4 | exonic | Both | NM_020911 | HS plexin A4 (PLXNA4), tv1, mRNA. |
| SEQ ID 2638 | PLXNA4 | exonic | Both | NM_001105543 | HS plexin A4 (PLXNA4), tv3, mRNA. |
| SEQ ID 2639 | FLJ40288 | exonic | #N/A | NR_046323 | HS uncharacterized FLJ40288 (FLJ40288), non-coding RNA. |
| SEQ ID 2640 | PLXNA4 | exonic | Both | NM_181775 | HS plexin A4 (PLXNA4), tv2, mRNA. |
| SEQ ID 2641 | PRSS2 | exonic | Loss | NM_002770 | HS protease, serine, 2 (trypsin 2) (PRSS2), mRNA. |
| SEQ ID 2642 | PTPRN2 | intronic | Both | NM_002847 | HS protein tyrosine phosphatase, receptor type, N polypeptide 2 (PTPRN2), tv1, mRNA. |
| SEQ ID 2643 | PTPRN2 | intronic | Both | NM_130843 | HS protein tyrosine phosphatase, receptor type, N polypeptide 2 (PTPRN2), tv3, mRNA. |
| SEQ ID 2644 | PTPRN2 | intronic | Both | NM_130842 | HS protein tyrosine phosphatase, receptor type, N polypeptide 2 (PTPRN2), tv2, mRNA. |
| SEQ ID 2645 | CHRNB3 | intronic | Both | NM_000749 | HS cholinergic receptor, nicotinic, beta 3 (neuronal) (CHRNB3), mRNA. |
| SEQ ID 2646 | ZNF517 | exonic | Loss | NM_213605 | HS zinc finger protein 517 (ZNF517), mRNA. |
| SEQ ID 2647 | IFNA22P | exonic | Gain | NR_036676 | HS interferon, alpha 22, pseudogene (IFNA22P), non-coding RNA. |
| SEQ ID 2648 | MIR3910-1 | exonic | Loss | NR_037472 | HS microRNA 3910-1 (MIR3910-1), microRNA. |
| SEQ ID 2649 | MIR3910-2 | exonic | Loss | NR_037489 | HS microRNA 3910-2 (MIR3910-2), microRNA. |
| SEQ ID 2650 | CTNNA3 | intronic | Loss | NM_013266 | HS catenin (cadherin-associated protein), alpha 3 (CTNNA3), tv1, mRNA. |
| SEQ ID 2651 | CTNNA3 | intronic | Loss | NM_001127384 | HS catenin (cadherin-associated protein), alpha 3 (CTNNA3), tv2, mRNA. |
| SEQ ID 2652 | C10orf11 | intronic | Gain | NM_032024 | HS chromosome 10 open reading frame 11 (C10orf11), mRNA. |
| SEQ ID 2653 | BTRC | intronic | Gain | NM_003939 | HS beta-transducin repeat containing E3 ubiquitin protein ligase (BTRC), tv2, mRNA. |
| SEQ ID 2654 | BTRC | intronic | Gain | NM_033637 | HS beta-transducin repeat containing E3 ubiquitin protein ligase (BTRC), tv1, mRNA. |
| SEQ ID 2655 | BTRC | intronic | Gain | NM_001256856 | HS beta-transducin repeat containing E3 ubiquitin protein ligase (BTRC), tv3, mRNA. |
| SEQ ID 2656 | SBF2 | intronic | Loss | NM_030962 | HS SET binding factor 2 (SBF2), mRNA. |
| SEQ ID 2657 | HSD17B12 | exonic | Loss | NM_016142 | HS hydroxysteroid (17-beta) dehydrogenase 12 (HSD17B12), mRNA. |
| SEQ ID 2658 | NAALAD2 | exonic | Loss | NM_005467 | HS N-acetylated alpha-linked acidic dipeptidase 2 (NAALAD2), mRNA. |
| SEQ ID 2659 | ERC1 | intronic | Both | NR_027948 | HS ELKS/RAB6-interacting/CAST family member 1 (ERC1), tvbeta, non-coding RNA. |
| SEQ ID 2660 | ERC1 | intronic | Both | NR_027949 | HS ELKS/RAB6-interacting/CAST family member 1 (ERC1), tvgamma, non-coding RNA. |
| SEQ ID 2661 | ERC1 | intronic | Both | NM_178040 | HS ELKS/RAB6-interacting/CAST family member 1 (ERC1), tvepsilon, mRNA. |
| SEQ ID 2662 | ERC1 | intronic | Both | NR_027946 | HS ELKS/RAB6-interacting/CAST family member 1 (ERC1), tvalpha, non-coding RNA. |
| SEQ ID 2663 | ERC1 | intronic | Both | NM_178039 | HS ELKS/RAB6-interacting/CAST family member 1 (ERC1), tvdelta, mRNA. |
| SEQ ID 2664 | ATXN2 | intronic | Loss | NM_002973 | HS ataxin 2 (ATXN2), mRNA. |
| SEQ ID 2665 | TRIAP1 | exonic | Gain | NM_016399 | HS TP53 regulated inhibitor of apoptosis 1 (TRIAP1), mRNA. |
| SEQ ID 2666 | GATC | exonic | Gain | NM_176818 | HS glutamyl-tRNA(Gln) amidotransferase, subunit C (GATC), tv1, mRNA. |

TABLE 7-continued

| SEQ ID | RefSeq Gene Symbol | CNV Gene Region | CNV Type | RefSeq Accession Number | RefSeq Gene Description/Definition (transcript variant = tv; HS = HS) |
|---|---|---|---|---|---|
| SEQ ID 2667 | COX6A1 | exonic | Gain | NM_004373 | HS cytochrome c oxidase subunit VIa polypeptide 1 (COX6A1), nuclear gene encoding mitochondrial protein, mRNA. |
| SEQ ID 2668 | GATC | exonic | Gain | NR_033684 | HS glutamyl-tRNA(Gln) amidotransferase, subunit C (GATC), tv2, non-coding RNA. |
| SEQ ID 2669 | GPHN | intronic | Loss | NM_001024218 | HS gephyrin (GPHN), tv2, mRNA. |
| SEQ ID 2670 | GPHN | intronic | Loss | NM_020806 | HS gephyrin (GPHN), tv1, mRNA. |
| SEQ ID 2671 | NRXN3 | both | Loss | NM_004796 | HS neurexin 3 (NRXN3), tv1, mRNA. |
| SEQ ID 2672 | NRXN3 | both | Loss | NM_001105250 | HS neurexin 3 (NRXN3), tv3, mRNA. |
| SEQ ID 2673 | NRXN3 | both | Loss | NM_138970 | HS neurexin 3 (NRXN3), tv2, mRNA. |
| SEQ ID 2674 | WDR25 | intronic | Loss | NM_001161476 | HS WD repeat domain 25 (WDR25), tv2, mRNA. |
| SEQ ID 2675 | WDR25 | intronic | Loss | NM_024515 | HS WD repeat domain 25 (WDR25), tv1, mRNA. |
| SEQ ID 2676 | EHD4 | intronic | Loss | NM_139265 | HS EH-domain containing 4 (EHD4), mRNA. |
| SEQ ID 2677 | CIB2 | exonic | Gain | NM_006383 | HS calcium and integrin binding family member 2 (CIB2), tv1, mRNA. |
| SEQ ID 2678 | IL32 | exonic | Loss | NM_001012635 | HS interleukin 32 (IL32), tv6, mRNA. |
| SEQ ID 2679 | IL32 | exonic | Loss | NM_004221 | HS interleukin 32 (IL32), tv2, mRNA. |
| SEQ ID 2680 | IL32 | exonic | Loss | NM_001012636 | HS interleukin 32 (IL32), tv7, mRNA. |
| SEQ ID 2681 | MMP25 | exonic | Loss | NM_022468 | HS matrix metallopeptidase 25 (MMP25), mRNA. |
| SEQ ID 2682 | IL32 | exonic | Loss | NM_001012633 | HS interleukin 32 (IL32), tv4, mRNA. |
| SEQ ID 2683 | IL32 | exonic | Loss | NM_001012632 | HS interleukin 32 (IL32), tv3, mRNA. |
| SEQ ID 2684 | IL32 | exonic | Loss | NM_001012631 | HS interleukin 32 (IL32), tv1, mRNA. |
| SEQ ID 2685 | IL32 | exonic | Loss | NM_001012634 | HS interleukin 32 (IL32), tv5, mRNA. |
| SEQ ID 2686 | IL32 | exonic | Loss | NM_001012718 | HS interleukin 32 (IL32), tv8, mRNA. |
| SEQ ID 2687 | JPH3 | intronic | Both | NM_020655 | HS junctophilin 3 (JPH3), tv1, mRNA. |
| SEQ ID 2688 | KLHDC4 | exonic | Loss | NM_017566 | HS kelch domain containing 4 (KLHDC4), tv1, mRNA. |
| SEQ ID 2689 | KLHDC4 | exonic | Loss | NM_001184856 | HS kelch domain containing 4 (KLHDC4), tv2, mRNA. |
| SEQ ID 2690 | KLHDC4 | exonic | Loss | NM_001184854 | HS kelch domain containing 4 (KLHDC4), tv3, mRNA. |
| SEQ ID 2691 | YWHAE | exonic | Gain | NM_006761 | HS tyrosine 3-monooxygenase/tryptophan 5-monooxygenase activation protein, epsilon polypeptide (YWHAE), tv1, mRNA. |
| SEQ ID 2692 | YWHAE | exonic | Gain | NR_024058 | HS tyrosine 3-monooxygenase/tryptophan 5-monooxygenase activation protein, epsilon polypeptide (YWHAE), tv2, non-coding RNA. |
| SEQ ID 2693 | TM4SF5 | exonic | Loss | NM_003963 | HS transmembrane 4 L six family member 5 (TM4SF5), mRNA. |
| SEQ ID 2694 | MYH4 | exonic | Loss | NM_017533 | HS myosin, heavy chain 4, skeletal muscle (MYH4), mRNA. |
| SEQ ID 2695 | BCAS3 | intronic | Loss | NM_001099432 | HS breast carcinoma amplified sequence 3 (BCAS3), tv1, mRNA. |
| SEQ ID 2696 | BCAS3 | intronic | Loss | NM_017679 | HS breast carcinoma amplified sequence 3 (BCAS3), tv2, mRNA. |
| SEQ ID 2697 | RAB3A | exonic | Gain | NM_002866 | HS RAB3A, member RAS oncogene family (RAB3A), mRNA. |
| SEQ ID 2698 | MPV17L2 | exonic | Gain | NM_032683 | HS MPV17 mitochondrial membrane protein-like 2 (MPV17L2), nuclear gene encoding mitochondrial protein, mRNA. |
| SEQ ID 2699 | SPTBN4 | exonic | Loss | NM_025213 | HS spectrin, beta, non-erythrocytic 4 (SPTBN4), tvsigma5, mRNA. |
| SEQ ID 2700 | SPTBN4 | exonic | Loss | NM_020971 | HS spectrin, beta, non-erythrocytic 4 (SPTBN4), tvsigma1, mRNA. |
| SEQ ID 2701 | LTBP4 | exonic | Loss | NM_001042544 | HS latent transforming growth factor beta binding protein 4 (LTBP4), tv1, mRNA. |
| SEQ ID 2702 | LTBP4 | exonic | Loss | NM_003573 | HS latent transforming growth factor beta binding protein 4 (LTBP4), tv2, mRNA. |
| SEQ ID 2703 | SHKBP1 | exonic | Loss | NM_138392 | HS SH3KBP1 binding protein 1 (SHKBP1), mRNA. |
| SEQ ID 2704 | LTBP4 | exonic | Loss | NM_001042545 | HS latent transforming growth factor beta binding protein 4 (LTBP4), tv3, mRNA. |
| SEQ ID 2705 | SAE1 | exonic | Gain | NR_027280 | HS SUMO1 activating enzyme subunit 1 (SAE1), tv4, non-coding RNA. |
| SEQ ID 2706 | SAE1 | exonic | Gain | NM_001145713 | HS SUMO1 activating enzyme subunit 1 (SAE1), tv2, mRNA. |
| SEQ ID 2707 | SAE1 | exonic | Gain | NM_001145714 | HS SUMO1 activating enzyme subunit 1 (SAE1), tv3, mRNA. |
| SEQ ID 2708 | SAE1 | exonic | Gain | NM_005500 | HS SUMO1 activating enzyme subunit 1 (SAE1), tv1, mRNA. |
| SEQ ID 2709 | SHANK1 | exonic | Loss | NM_016148 | HS SH3 and multiple ankyrin repeat domains 1 (SHANK1), mRNA. |
| SEQ ID 2710 | CLEC11A | exonic | Loss | NM_002975 | HS C-type lectin domain family 11, member A (CLEC11A), mRNA. |
| SEQ ID 2711 | MIR99B | exonic | Loss | NR_029843 | HS microRNA 99b (MIR99B), microRNA. |
| SEQ ID 2712 | LINC00085 | exonic | Loss | NR_024330 | HS long intergenic non-protein coding RNA 85 (LINC00085), non-coding RNA. |
| SEQ ID 2713 | MIRLET7E | exonic | Loss | NR_029482 | HS microRNA let-7e (MIRLET7E), microRNA. |
| SEQ ID 2714 | MIR125A | exonic | Loss | NR_029693 | HS microRNA 125a (MIR125A), microRNA. |
| SEQ ID 2715 | TRIB3 | exonic | Loss | NM_021158 | HS tribbles homolog 3 (*Drosophila*) (TRIB3), mRNA. |
| SEQ ID 2716 | PANK2 | intronic | Loss | NM_024960 | HS pantothenate kinase 2 (PANK2), tv3, mRNA. |
| SEQ ID 2717 | PANK2 | intronic | Loss | NM_153640 | HS pantothenate kinase 2 (PANK2), tv2, mRNA. |
| SEQ ID 2718 | PANK2 | intronic | Loss | NM_153638 | HS pantothenate kinase 2 (PANK2), nuclear gene encoding mitochondrial protein, tv1, mRNA. |
| SEQ ID 2719 | LINC00478 | both | Loss | NR_027790 | HS long intergenic non-protein coding RNA 478 (LINC00478), tv1, non-coding RNA. |
| SEQ ID 2720 | LINC00478 | both | Loss | NR_027791 | HS long intergenic non-protein coding RNA 478 (LINC00478), tv2, non-coding RNA. |
| SEQ ID 2721 | DHRSX | both | Both | NM_145177 | HS dehydrogenase/reductase (SDR family) X-linked (DHRSX), mRNA. |
| SEQ ID 2722 | SYAP1 | exonic | Gain | NR_033181 | HS synapse associated protein 1 (SYAP1), tv2, non-coding RNA. |
| SEQ ID 2723 | SYAP1 | exonic | Gain | NM_032796 | HS synapse associated protein 1 (SYAP1), tv1, mRNA. |
| SEQ ID 2724 | APOO | exonic | Gain | NR_026545 | HS apolipoprotein O (APOO), tv2, non-coding RNA. |
| SEQ ID 2725 | APOO | exonic | Gain | NM_024122 | HS apolipoprotein O (APOO), tv1, mRNA. |
| SEQ ID 2726 | DMD | intronic | Both | NM_004012 | HS dystrophin (DMD), tvDp260-2, mRNA. |
| SEQ ID 2727 | DMD | intronic | Both | NM_004010 | HS dystrophin (DMD), tvDp427p2, mRNA. |
| SEQ ID 2728 | DMD | intronic | Both | NM_004011 | HS dystrophin (DMD), tvDp260-1, mRNA. |
| SEQ ID 2729 | DMD | intronic | Both | NM_000109 | HS dystrophin (DMD), tvDp427c, mRNA. |
| SEQ ID 2730 | DMD | intronic | Both | NM_004007 | HS dystrophin (DMD), tvDp427l, mRNA. |

TABLE 7-continued

| SEQ ID | RefSeq Gene Symbol | CNV Gene Region | CNV Type | RefSeq Accession Number | RefSeq Gene Description/Definition (transcript variant = tv; HS = HS) |
|---|---|---|---|---|---|
| SEQ ID 2731 | DMD | intronic | Both | NM_004021 | HS dystrophin (DMD), tvDp140b, mRNA. |
| SEQ ID 2732 | DMD | intronic | Both | NM_004013 | HS dystrophin (DMD), tvDp140, mRNA. |
| SEQ ID 2733 | DMD | intronic | Both | NM_004020 | HS dystrophin (DMD), tvDp140c, mRNA. |
| SEQ ID 2734 | DMD | intronic | Both | NM_004006 | HS dystrophin (DMD), tvDp427m, mRNA. |
| SEQ ID 2735 | DMD | intronic | Both | NM_004009 | HS dystrophin (DMD), tvDp427p1, mRNA. |
| SEQ ID 2736 | DMD | intronic | Both | NM_004023 | HS dystrophin (DMD), tvDp140bc, mRNA. |
| SEQ ID 2737 | DMD | intronic | Both | NM_004022 | HS dystrophin (DMD), tvD140ab, mRNA. |
| SEQ ID 2738 | DIAPH2 | intronic | Loss | NM_006729 | HS diaphanous homolog 2 (*Drosophila*) (DIAPH2), tv156, mRNA. |
| SEQ ID 2739 | DIAPH2 | intronic | Loss | NM_007309 | HS diaphanous homolog 2 (*Drosophila*) (DIAPH2), tv12C, mRNA. |

Table 7 represents a list of all genes listed in Table 5 (non-redundant) and Table 6. Column 2 lists the RefSeq Gene Symbol for each gene. Column 4 refers to the CNV classification based on whether each CNV found in the subjects was duplicated/amplified (gain) or deleted (loss) in the genome. Column 3 refers to whether the CNV Gene Region (i.e., portion of the gene impacted by the CNV) is intronic, exonic or both. "Intronic" refers to CNVs affecting introns only; "Exonic" refers to CNVs affecting part or all of one or more exons, which may include adjacent intronic regions if the CNV extends beyond the exonic region. Column 1 refers to the assigned sequence ID of full genomic extent of each of the transcripts. Column 5 refers to the RefSeq RNA Accession number. Column 6 refers to a brief description of an RNA (usually an mRNA, but can be a non-coding RNA) for each respective gene, including multiple mRNA or other RNA entries associated with a gene.

In one embodiment, the transcripts listed in Table 7 can be expression products of the same gene biomarker as listed in Table 5 or 6. In some embodiments, a gene biomarker can comprise genomic DNA encoding the gene, including exons, introns, and/or regulatory binding regions (such as enhancers, promoters, silencers, and/or response elements). In one embodiment, point mutations, polymorphisms, translocations, insertions, deletions, amplifications, inversions, microsatellites, interstitial deletions, copy number variations (CNVs), loss of heterozygosity, or any other aberrations which affect the structure or function of one or more gene biomarkers and/or expression products thereof, are associated with a developmental disorder as described herein.

Computer-Implemented Aspects

As understood by those of ordinary skill in the art, the methods and information described herein (genetic variation association with developmental disorders) can be implemented, in all or in part, as computer executable instructions on known computer readable media. For example, the methods described herein can be implemented in hardware. Alternatively, the method can be implemented in software stored in, for example, one or more memories or other computer readable medium and implemented on one or more processors. As is known, the processors can be associated with one or more controllers, calculation units and/or other units of a computer system, or implanted in firmware as desired. If implemented in software, the routines can be stored in any computer readable memory such as in RAM, ROM, flash memory, a magnetic disk, a laser disk, or other storage medium, as is also known. Likewise, this software can be delivered to a computing device via any known delivery method including, for example, over a communication channel such as a telephone line, the Internet, a wireless connection, etc., or via a transportable medium, such as a computer readable disk, flash drive, etc.

More generally, and as understood by those of ordinary skill in the art, the various steps described above can be implemented as various blocks, operations, tools, modules and techniques which, in turn, can be implemented in hardware, firmware, software, or any combination of hardware, firmware, and/or software. When implemented in hardware, some or all of the blocks, operations, techniques, etc. can be implemented in, for example, a custom integrated circuit (IC), an application specific integrated circuit (ASIC), a field programmable logic array (FPGA), a programmable logic array (PLA), etc.

Results from such genotyping can be stored in a data storage unit, such as a data carrier, including computer databases, data storage disks, or by other convenient data storage means. In certain embodiments, the computer database is an object database, a relational database or a post-relational database. Data can be retrieved from the data storage unit using any convenient data query method.

When implemented in software, the software can be stored in any known computer readable medium such as on a magnetic disk, an optical disk, or other storage medium, in a RAM or ROM or flash memory of a computer, processor, hard disk drive, optical disk drive, tape drive, etc. Likewise, the software can be delivered to a user or a computing system via any known delivery method including, for example, on a computer readable disk or other transportable computer storage mechanism.

The steps of the claimed methods can be operational with numerous other general purpose or special purpose computing system environments or configurations. Examples of well known computing systems, environments, and/or configurations that can be suitable for use with the methods or system of the claims include, but are not limited to, personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, and the like.

The steps of the claimed method and system can be described in the general context of computer-executable instructions, such as program modules, being executed by a computer. Generally, program modules include routines, programs, objects, components, and/or data structures that perform particular tasks or implement particular abstract data types. The methods and apparatus can also be practiced in distributed computing environments where tasks are performed by remote processing devices that are linked through a communications network. In both integrated and distributed computing environments, program modules can be located in both local and remote computer storage media including memory storage devices. Numerous alternative embodiments could be implemented, using either current technology or technology developed after the filing date of this application, which would still fall within the scope of the claims defining the disclosure.

While the risk evaluation system and method, and other elements, have been described as preferably being implemented in software, they can be implemented in hardware, firmware, etc., and can be implemented by any other processor. Thus, the elements described herein can be implemented in a standard multi-purpose CPU or on specifically designed hardware or firmware such as an application-specific integrated circuit (ASIC) or other hard-wired device as desired. When implemented in software, the software routine can be stored in any computer readable memory such as on a magnetic disk, a laser disk, or other storage medium, in a RAM or ROM of a computer or processor, in any database, etc. Likewise, this software can be delivered to a user or a screening system via any known or desired delivery method including, for example, on a computer readable disk or other transportable computer storage mechanism or over a communication channel, for example, a telephone line, the internet, or wireless communication. Modifications and variations can be made in the techniques and structures described and illustrated herein without departing from the spirit and scope of the present disclosure.

ASD Therapeutics

Research into a cure for Pervasive Developmental Disorders (PDD), such as ASD or Pervasive Developmental Disorders-Not Otherwise Specified (PDD-NOS), such as Asperger Syndrome, Rett Syndrome, fragile X syndrome, and/or Childhood Disintegrative Disorder is ongoing. Ways to help minimize the symptoms of autism and to maximize learning exist, including but not limited to, behavioral therapy, educational and/or school-based options, and medication options, although currently there are no medications that can cure autism spectrum disorders or all of the symptoms. The U.S. Food and Drug Administration has not yet approved any medications specifically for the treatment of autism, but in many cases medication can treat some of the symptoms associated with autism. These treatments can include behavior management therapy to help reinforce wanted behaviors and reduce unwanted behaviors, which is often based on Applied Behavior Analysis (ABA), use of speech-language therapists to help people with autism improve their ability to communicate and interact with others, use of occupational therapists to help people find ways to adjust tasks to match their needs and abilities, and physical therapists design activities and exercise to build motor control and improve posture and balance, free appropriate public education from age 3 through high school or age 21, integration of a team of people, including the parents, teachers, caregivers, school psychologists, and other child development specialists to work together to design an Individualized Education Plan (IEP) to help guide the child's school experiences, selective serotonin reuptake inhibitors (SSRIs), tricyclics, psychoactive/anti-psychotics, stimulants, and anti-anxiety drugs are among the medications that a health care provider might use to treat symptoms of autism spectrum disorders.

A person skilled in the art will appreciate and understand that the genetic variants described herein in general may not, by themselves, provide an absolute identification of individuals who will develop a developmental disorder or related conditions. The variants described herein can indicate increased and/or decreased likelihood that individuals carrying the at-risk or protective variants of the disclosure will develop symptoms associated with a developmental disorder. This information can be used to, for example, initiate preventive measures at an early stage, perform regular physical and/or mental exams to monitor the progress and/or appearance of symptoms, or to schedule exams at a regular interval to identify early symptoms, so as to be able to apply treatment at an early stage. This is in particular important since developmental disorders and related disorders are heterogeneous disorders with symptoms that can be individually vague. Screening criteria require a number of symptoms to be present over a period of time; therefore, it is important to be able to establish additional risk factors that can aid in the screening, or facilitate the screening through in-depth phenotyping and/or more frequent examination, or both. For example, individuals with early symptoms that typically are not individually associated with a clinical screening of a developmental disorder and carry an at-risk genetic variation can benefit from early therapeutic treatment, or other preventive measure, or more rigorous supervision or more frequent examination. Likewise, individuals that have a family history of the disease, or are carriers of other risk factors associated with a developmental disorder can, in the context of additionally carrying at least one at-risk genetic variation, benefit from early therapy or other treatment.

Early symptoms of behavioral disorders such as a developmental disorder and related conditions may not be sufficient to fulfill standardized screening criteria. To fulfill those, a certain pattern of symptoms and behavioral disturbance needs to manifest itself over a period of time. Sometimes, certain physical characteristics can also be present. This makes at-risk genetic variants valuable in a screening setting, in particular high-risk variants. Determination of the presence of such variants warrants increased monitoring of the individual in question. Appearance of symptoms combined with the presence of such variants facilitates early screening, which makes early treatment possible. Genetic testing can thus be used to aid in the screening of disease in its early stages, before all criteria for formal screening criteria are all fulfilled. It is well established that early treatment is extremely important for developmental disorders and related disorders, which lends further support to the value of genetic testing for early diagnosis, prognosis, or theranosis of these disorders.

The present disclosure provides methods for identifying compounds or agents that can be used to treat a developmental disorder. Thus, the genetic variations and associated proteins of the disclosure are useful as targets for the identification and/or development of therapeutic agents. In certain embodiments, such methods include assaying the ability of an agent or compound to modulate the activity and/or expression of a nucleic acid that is associated with at least one genetic variation described herein (Tables 1 and 5), encoded products of the gene sequence, and any other molecules or proteins associated with these genes. This in turn can be used to identify agents or compounds that inhibit, enhance, or alter the undesired activity, localization, binding and/or expression of the encoded nucleic acid product, such as mRNA or polypeptides. For example, in some embodiments, small molecule drugs can be developed to target the aberrant protein(s) or RNA(s) resulting from specific disease-causing mutation(s) within a gene, such as described in: Peltz et al. (2009) RNA Biology 6(3):329-34; Van Goor et al. (2009) Proc. Natl. Acad. Sci. USA 106(44): 18825-30; Van Goor et al. (2011) Proc. Natl. Acad. Sci. USA 108(46):18843-8; Ramsey et al. (2011) N. Engl. J. Med. 365(18):1663-72. The proteins associated with the CNVs listed in Tables 1 and 5 are described in Tables 4 and 7 as the accession number (accession) of mRNAs that would encode said proteins. Assays for performing such experiments can be performed in cell-based systems or in cell-free systems, as known to the skilled person. Cell-based systems include cells naturally expressing the nucleic acids of interest, or recombinant cells that have been genetically modified so as to express a certain desired nucleic acid molecule.

Variant gene expression in a subject can be assessed by expression of a variant-containing nucleic acid sequence or by altered expression of a normal/wild-type nucleic acid sequence due to variants affecting the level or pattern of expression of the normal transcripts, for example, variants in the regulatory or control region of the gene. Assays for gene expression include direct nucleic acid assays (mRNA), assays for expressed protein levels, or assays of collateral compounds involved in a pathway, for example, a signal pathway. Furthermore, the expression of genes that are up- or down-regulated in response to the signal pathway can also be assayed. Some embodiments include operably linking a reporter gene, such as luciferase, to the regulatory region of one or more gene of interest.

Modulators of gene expression can in some embodiments be identified when a cell is contacted with a candidate compound or agent, and the expression of mRNA is determined. The expression level of mRNA in the presence of the candidate compound or agent is compared to the expression level in the absence of the compound or agent. Based on this comparison, candidate compounds or agents for treating a developmental disorder can be identified as those modulating the gene expression of the variant gene, or gene expression of one or more other genes occurring within the same biological pathway or known, for example, to be binding partners of the variant gene. When expression of mRNA or the encoded protein is statistically significantly greater in the presence of the candidate compound or agent than in its absence, then the candidate compound or agent is identified as a stimulator or up-regulator of expression of the nucleic acid. When nucleic acid expression or protein level is statistically significantly less in the presence of the candidate compound or agent than in its absence, then the candidate compound can be identified as an inhibitor or down-regulator of the nucleic acid expression. The disclosure further provides methods of treatment using a compound identified through drug (compound and/or agent) screening as a gene modulator.

The genetic variations described herein can be used to identify novel therapeutic targets for a developmental disorder. For example, genes containing, or in linkage disequilibrium with, the genetic variations, or their products, as well as genes or their products that are directly or indirectly regulated by or interact with these variant genes or their products, can be targeted for the development of therapeutic agents to treat a developmental disorder, or prevent or delay onset of symptoms associated with a developmental disorder. Therapeutic agents can comprise one or more of, for example, small non-protein and non-nucleic acids, proteins, peptides, protein fragments, nucleic acids (DNA, RNAJ, PNA (peptide nucleic acids), or their derivatives or mimetics which can modulate the function and/or levels of the target genes or their gene products. In some embodiments, treatment of ASD can comprise treatment of one of the genes, or gene products derived thereof, such as mRNA or a polypeptide, with one or more of the therapeutics disclosed herein. In some embodiments, treatment of ASD can comprise treatment of 2 or 3, or 4, or 5, or 6, or 7, or 8, or 9, or or more of the genes, or gene products derived there from, with 2 or 3, or 4, or 5, or 6, or 7, or 8, or 9, or 10 or more of the therapeutics disclosed herein.

RNA Therapeutics

The nucleic acids and/or variants of the disclosure, or nucleic acids comprising their complementary sequence, can be used as antisense constructs to control gene expression in cells, tissues or organs. The methodology associated with antisense techniques is well known to the skilled artisan, and is described and reviewed in Antisense Drug Technology: Principles, Strategies, and Applications, Crooke, Marcel Dekker Inc., New York (2001) In general, antisense nucleic acids are designed to be complementary to a region of mRNA expressed by a gene, so that the antisense molecule hybridizes to the mRNA, thus blocking translation of the mRNA into protein Several classes of antisense oligonucleotide are known to those skilled in the art, including cleavers and blockers. The former bind to target RNA sites, activate intracellular nucleases {e.g., Rnase H or Rnase L) that cleave the target RNA. Blockers bind to target RNA, inhibit protein translation by steric hindrance of the ribosomes. Examples of blockers include nucleic acids, morpholino compounds, locked nucleic acids and methylphosphonates (Thompson, Drug Discovery Today, 7:912-917 (2002)) Antisense oligonucleotides are useful directly as therapeutic agents, and are also useful for determining and validating gene function, for example, by gene knock-out or gene knockdown experiments. Antisense technology is further described in Lavery et al., Curr. Opin. Drug Discov Devel 6 561-569 (2003), Stephens et al., Curr. Opin. Mol Ther. 5.118-122 (2003), Kurreck, Eur. J. Biochem. 270.1628-44 (2003), Dias et al, Mol Cancer Ter. 1-347-55 (2002), Chen, Methods Mol Med. 75:621-636 (2003), Wang et al., Curr Cancer Drug Targets 1.177-96 (2001), and Bennett, Antisense Nucleic Acid Drug. Dev. 12 215-24 (2002)

The variants described herein can be used for the selection and design of antisense reagents that are specific for particular variants (e.g., particular genetic variations, or polymorphic markers in LD with particular genetic variations). Using information about the variants described herein, antisense oligonucleotides or other antisense molecules that specifically target mRNA molecules that contain one or more variants of the disclosure can be designed. In this manner, expression of mRNA molecules that contain one or more variant of the present disclosure (markers and/or haplotypes) can be inhibited or blocked In some embodiments, the antisense molecules are designed to specifically bind a particular allelic form (i.e., one or several variants (alleles and/or haplotypes)) of the target nucleic acid, thereby inhibiting translation of a product originating from this specific allele or haplotype, but which do not bind other or alternate variants at the specific polymorphic sites of the target nucleic acid molecule.

As antisense molecules can be used to inactivate mRNA so as to inhibit gene expression, and thus protein expression, the molecules can be used to treat a disease or disorder, such as a developmental disorder. The methodology can involve cleavage by means of ribozymes containing nucleotide sequences complementary to one or more regions in the mRNA that attenuate the ability of the mRNA to be translated Such mRNA regions include, for example, protein-coding regions, in particular protein-coding regions corresponding to catalytic activity, substrate and/or ligand binding sites, or other functional domains of a protein.

The phenomenon of RNA interference (RNAi) has been actively studied for the last decade, since its original discovery in C. elegans (Fire et al., Nature 391:806-11 (1998)), and in recent years its potential use in treatment of human disease has been actively pursued (reviewed in Kim & Rossi, Nature Rev, Genet. 8: 173-204 (2007)). RNA interference (RNAi), also called gene silencing, is based on using double-stranded RNA molecules (dsRNA) to turn off specific genes. In the cell, cytoplasmic double-stranded RNA molecules (dsRNA) are processed by cellular complexes into small interfering RNA (siRNA). The siRNA guide the targeting of a protein-RNA complex to specific sites on a target mRNA, leading to cleavage of the mRNA (Thompson, Drug Discovery Today, 7:912-917 (2002)). The siRNA molecules are typically about 20, 21, 22 or 23 nucleotides in length. Thus, one aspect of the disclosure relates to isolated nucleic acid sequences, and the use of those molecules for RNA interference, for example, as small interfering RNA molecules (siRNA). In some embodiments, the isolated nucleic acid sequences can be 18-26 nucleotides in length, preferably 19-25 nucleotides in length, more preferably 20-24 nucleotides in length, and more preferably 21, 22 or 23 nucleotides in length.

Another pathway for RNAi-mediated gene silencing originates in endogenously encoded primary microRNA (pn-miRNA) transcripts, which are processed in the cell to generate precursor miRNA (pre-miRNA). These miRNA molecules are exported from the nucleus to the cytoplasm, where they undergo processing to generate mature miRNA molecules (miRNA), which direct translational inhibition by recognizing target sites in the 3' untranslated regions of mRNAs, and subsequent mRNA degradation by processing P-bodies (reviewed in Kim & Rossi, Nature Rev. Genet. 8: 173-204 (2007)).

Clinical applications of RNAi include the incorporation of synthetic siRNA duplexes, which preferably are approximately 20-23 nucleotides in size, and preferably have 3' overlaps of 2 nucleotides. Knockdown of gene expression is established by sequence-specific design for the target mRNA. Several commercial sites for optimal design and synthesis of such molecules are known to those skilled in the art.

Other applications provide longer siRNA molecules (typically 25-30 nucleotides in length, preferably about 27 nucleotides), as well as small hairpin RNAs (shRNAs; typically about 29 nucleotides in length). The latter are naturally expressed, as described in Amarzguioui et al. (FEBS Lett. 579:5974-81 (2005)). Chemically synthetic siRNAs and shRNAs are substrates for in vivo processing, and in some cases provide more potent gene-silencing than shorter designs (Kim et al., Nature Biotechnol. 23:222-226 (2005); Siola et al., Nature Biotechnol. 23:227-231 (2005)). In general siRNAs provide for transient silencing of gene expression, because their intracellular concentration is diluted by subsequent cell divisions. By contrast, expressed shRNAs mediate long-term, stable knockdown of target transcripts, for as long as transcription of the shRNA takes place (Marques et al., Nature Biotechnol. 23.559-565 (2006), Brummelkamp et al., Science 296. 550-553 (2002)).

Since RNAi molecules, including siRNA, miRNA and shRNA, act in a sequence-dependent manner, variants described herein can be used to design RNAi reagents that recognize specific nucleic acids comprising specific genetic variations, alleles and/or haplotypes, while not recognizing nucleic acid sequences not comprising the genetic variation, or comprising other alleles or haplotypes. These RNAi reagents can thus recognize and destroy the target nucleic acid sequences. As with antisense reagents, RNAi reagents can be useful as therapeutic agents (i.e., for turning off disease-associated genes or disease-associated gene variants), but can also be useful for characterizing and validating gene function (e.g., by gene knock-out or gene knock-down experiments).

Delivery of RNAi can be performed by a range of methodologies known to those skilled in the art. Methods utilizing non-viral delivery include cholesterol, stable nucleic acid-lipid particle (SNALP), heavy-chain antibody fragment (Fab), aptamers and nanoparticles Viral delivery methods include use of lentivirus, adenovirus and adeno-associated virus The siRNA molecules are in some embodiments chemically modified to increase their stability. This can include modifications at the 2' position of the ribose, including 2'-O-methylpunnes and 2'-fluoropyrimidmes, which provide resistance to RNase activity. Other chemical modifications are possible and known to those skilled in the art.

The following references provide a further summary of RNAi, and possibilities for targeting specific genes using RNAi: Kim & Rossi, Nat. Rev. Genet. 8: 173-184 (2007), Chen & Rajewsky, Nat. Rev. Genet. 8: 93-103 (2007), Reynolds, et al., Nat. Biotechnol 22 326-330 (2004), Chi et al., Proc. Natl. Acad. Sa. USA 100-6343-6346 (2003), Vickers et al., J Biol Chem. 278:7108-7118 (2003), Agami, Curr Opin. Chem. Biol. 6:829-834 (2002), Lavery, et al., Curr. Opin. Drug Discov. Devel. 6:561-569 (2003), Shi, Trends Genet. 19:9-12 (2003), Shuey et al., Drug Discov. Today 7 1040-46 (2002), McManus et al., Nat. Rev. Genet. 3.737-747 (2002), Xia et al., Nat. Biotechnol. 20.1006-10 (2002), Plasterk et al., Curr. Opin Genet. Dev. 10 562-7 (2000), Bosher et al., Nat. Cell Biol. 2:E31-6 (2000), and Hunter, Curr. Biol. 9:R440-442 (1999).

A genetic defect leading to increased predisposition or risk for development of a disease, including a developmental disorder, or a defect causing the disease, can be corrected permanently by administering to a subject carrying the defect a nucleic acid fragment that incorporates a repair sequence that supplies the normal/wild-type nucleotide(s) at the site of the genetic defect. Such site-specific repair sequence can encompass an RNA/DNA oligonucleotide that operates to promote endogenous repair of a subject's genomic DNA. The administration of the repair sequence can be performed by an appropriate vehicle, such as a complex with polyethelamine, encapsulated in anionic liposomes, a viral vector such as an adenovirus vector, or other pharmaceutical compositions suitable for promoting intracellular uptake of the administered nucleic acid The genetic defect can then be overcome, since the chimeric oligonucleotides induce the incorporation of the normal sequence into the genome of the subject, leading to expression of the normal/wild-type gene product. The replacement is propagated, thus rendering a permanent repair and alleviation of the symptoms associated with the disease or condition.

Double stranded oligonucleotides are formed by the assembly of two distinct oligonucleotide sequences where the oligonucleotide sequence of one strand is complementary to the oligonucleotide sequence of the second strand; such double stranded oligonucleotides are generally assembled from two separate oligonucleotides (e.g., siRNA), or from a single molecule that folds on itself to form a double stranded structure (e.g., shRNA or short hairpin RNA). These double stranded oligonucleotides known in the art all have a common feature in that each strand of the duplex has a distinct nucleotide sequence, wherein only one nucleotide sequence region (guide sequence or the antisense sequence) has complementarity to a target nucleic acid sequence and the other strand (sense sequence) comprises nucleotide sequence that is homologous to the target nucleic acid sequence.

Double stranded RNA induced gene silencing can occur on at least three different levels: (i) transcription inactivation, which refers to RNA guided DNA or histone methylation; (ii) siRNA induced mRNA degradation; and (iii) mRNA induced transcriptional attenuation. It is generally considered that the major mechanism of RNA induced silencing (RNA interference, or RNAi) in mammalian cells is mRNA degradation. RNA interference (RNAi) is a mechanism that inhibits gene expression at the stage of translation or by hindering the transcription of specific genes. Specific RNAi pathway proteins are guided by the dsRNA to the targeted messenger RNA (mRNA), where they "cleave" the target, breaking it down into smaller portions that can no longer be translated into protein. Initial attempts to use RNAi in mammalian cells focused on the use of long strands of dsRNA. However, these attempts to induce RNAi met with limited success, due in part to the induction of the interferon response, which results in a general, as opposed to a target-specific, inhibition of protein synthesis. Thus, long dsRNA is not a viable option for RNAi in mammalian systems. Another outcome is epigenetic changes to a gene—histone modification and DNA methylation—affecting the degree the gene is transcribed.

More recently it has been shown that when short (18-30 bp) RNA duplexes are introduced into mammalian cells in culture, sequence-specific inhibition of target mRNA can be realized without inducing an interferon response. Certain of these short dsRNAs, referred to as small inhibitory RNAs ("siRNAs"), can act catalytically at sub-molar concentrations to cleave greater than 95% of the target mRNA in the cell. A description of the mechanisms for siRNA activity, as well as some of its applications are described in Provost et al., Ribonuclease Activity and RNA Binding of Recombinant Human Dicer, E.M.B.O. J., 2002 Nov. 1; 21(21): 5864-5874; Tabara et al., The dsRNA Binding Protein RDE-4 Interacts with RDE-1, DCR-1 and a DexH-box Helicase to Direct RNAi in *C. elegans*, Cell 2002, Jun. 28; 109(7):861-71; Ketting et al., Dicer Functions in RNA Interference and in Synthesis of Small RNA Involved in Developmental Timing in *C. elegans*; Martinez et al., Single-Stranded Antisense siRNAs Guide Target RNA Cleavage in RNAi, Cell 2002, Sep. 6; 110(5):563; Hutvagner & Zamore, A microRNA in a multiple-turnover RNAi enzyme complex, Science 2002, 297:2056.

From a mechanistic perspective, introduction of long double stranded RNA into plants and invertebrate cells is broken down into siRNA by a Type III endonuclease known as Dicer. Sharp, RNA interference—2001, Genes Dev. 2001, 15:485. Dicer, a ribonuclease-III-like enzyme, processes the dsRNA into 19-23 base pair short interfering RNAs with characteristic two base 3' overhangs. Bernstein, Caudy, Hammond, & Hannon, Role for a bidentate ribonuclease in the initiation step of RNA interference, Nature 2001, 409: 363. The siRNAs are then incorporated into an RNA-induced silencing complex (RISC) where one or more helicases unwind the siRNA duplex, enabling the complementary antisense strand to guide target recognition (Nykanen, Haley, & Zamore, ATP requirements and small interfering RNA structure in the RNA interference pathway, Cell 2001, 107:309). Upon binding to the appropriate target mRNA, one or more endonucleases within the RISC cleaves the target to induce silencing. Elbashir, Lendeckel, & Tuschl, RNA interference is mediated by 21- and 22-nucleotide RNAs, Genes Dev 2001, 15:188, FIG. 1.

Generally, the antisense sequence is retained in the active RISC complex and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC complex (see for example, Schwarz et al., 2003, Cell, 115, 199-208). In this instance the sense sequence is believed to direct the RISC complex to a sequence (off-target sequence) that is distinct from the intended target sequence, resulting in the inhibition of the off-target sequence. In these double stranded nucleic acid sequences, each strand is complementary to a distinct target nucleic acid sequence. However, the off-targets that are affected by these dsRNAs are not entirely predictable and are non-specific.

The term "siRNA" refers to small inhibitory RNA duplexes that induce the RNA interference (RNAi) pathway. These molecules can vary in length (generally between 18-30 basepairs) and contain varying degrees of complementarity to their target mRNA in the antisense strand. Some, but not all, siRNA have unpaired overhanging bases on the 5' or 3' end of the sense strand and/or the antisense strand. The term "siRNA" includes duplexes of two separate strands, as well as single strands that can form hairpin structures comprising a duplex region. Small interfering RNA (siRNA), sometimes known as short interfering RNA or silencing RNA, are a class of 20-25 nucleotide-long double-stranded RNA molecules that play a variety of roles in biology.

While the two RNA strands do not need to be completely complementary, the strands should be sufficiently complementary to hybridize to form a duplex structure. In some instances, the complementary RNA strand can be less than 30 nucleotides, preferably less than 25 nucleotides in length, more preferably 19 to 24 nucleotides in length, more preferably 20-23 nucleotides in length, and even more preferably 22 nucleotides in length. The dsRNA of the present disclosure can further comprise at least one single-stranded nucleotide overhang. The dsRNA of the present disclosure can further comprise a substituted or chemically modified nucleotide. As discussed in detail below, the dsRNA can be synthesized by standard methods known in the art.

siRNA can be divided into five (5) groups including non-functional, semi-functional, functional, highly functional, and hyper-functional based on the level or degree of silencing that they induce in cultured cell lines. As used herein, these definitions are based on a set of conditions where the siRNA is transfected into said cell line at a concentration of 100 nM and the level of silencing is tested at a time of roughly 24 hours after transfection, and not exceeding 72 hours after transfection. In this context, "non-functional siRNA" are defined as those siRNA that induce less than 50% (<50%) target silencing. "Semi-functional siRNA" induce 50-79% target silencing. "Functional siRNA" are molecules that induce 80-95% gene silencing. "Highly-functional siRNA" are molecules that induce greater than 95% gene silencing. "Hyperfunctional siRNA" are a special class of molecules. For purposes of this document, hyperfunctional siRNA are defined as those molecules that: (1) induce greater than 95% silencing of a specific target when they are transfected at subnanomolar concentrations (i.e., less than one nanomolar); and/or (2) induce functional (or better) levels of silencing for greater than 96 hours. These relative functionalities (though not intended to be absolutes) can be used to compare siRNAs to a particular target for applications such as functional genomics, target identification and therapeutics.

microRNAs (miRNA) are single-stranded RNA molecules of about 21-23 nucleotides in length, which regulate gene expression. miRNAs are encoded by genes that are transcribed from DNA but not translated into protein (non-coding RNA); instead they are processed from primary transcripts known as pri-miRNA to short stem-loop structures called pre-miRNA and finally to functional miRNA. Mature miRNA molecules are partially complementary to one or more messenger RNA (mRNA) molecules, and their main function is to downregulate gene expression.

Antibody-Based Therapeutics

The present disclosure embodies agents that modulate a peptide sequence or RNA expressed from a gene associated with a developmental disorder. The term biomarker, as used herein, can comprise a genetic variation of the present disclosure or a gene product, for example, RNA and polypeptides, of any one of the genes listed in Tables 2-7. Such modulating agents include, but are not limited to, proteins, peptides, peptidomimetics, peptoids, or any other forms of a molecule, which bind to, and alter the signaling or function associated with the a developmental disorder associated biomarker, have an inhibitory or stimulatory effect on the developmental disorder associated biomarkers, or have a stimulatory or inhibitory effect on the expression or activity of the a developmental disorder associated biomarkers' ligands, for example, polyclonal antibodies and/or monoclonal antibodies that specifically bind one form of the gene product but not to the other form of the gene product are also provided, or which bind a portion of either the variant or the reference gene product that contains the polymorphic site or sites.

In some embodiments, the present disclosure provides antibody-based agents targeting a developmental disorder associated biomarkers. The antibody-based agents in any suitable form of an antibody e.g., monoclonal, polyclonal, or synthetic, can be utilized in the therapeutic methods disclosed herein. The antibody-based agents include any target-binding fragment of an antibody and also peptibodies, which are engineered therapeutic molecules that can bind to human drug targets and contain peptides linked to the constant domains of antibodies. In some embodiments, the antibodies used for targeting a developmental disorder associated biomarkers are humanized antibodies. Methods for humanizing antibodies are well known in the art. In another embodiment, the therapeutic antibodies comprise an antibody generated against a developmental disorder associated biomarkers described in the present disclosure, wherein the antibodies are conjugated to another agent or agents, for example, a cytotoxic agent or agents.

The term "antibody" as used herein refers to immunoglobulin molecules and immunologically active portions of immunoglobulin molecules, i.e., molecules that contain antigen-binding sites that specifically bind an antigen. A molecule that specifically binds to a polypeptide of the disclosure is a molecule that binds to that polypeptide or a fragment thereof, but does not substantially bind other molecules in a sample, e.g., a biological sample, which naturally contains the polypeptide. Examples of immunologically active portions of immunoglobulin molecules include F(ab) and F(ab')2 fragments which can be generated by treating the antibody with an enzyme such as pepsin. The disclosure provides polyclonal and monoclonal antibodies that bind to a polypeptide of the disclosure. The term "monoclonal antibody" or "monoclonal antibody composition", as used herein, refers to a population of antibody molecules that contain only one species of an antigen binding site capable of immunoreacting with a particular epitope of a polypeptide of the disclosure. A monoclonal antibody composition thus typically displays a single binding affinity for a particular polypeptide of the disclosure with which it immunoreacts.

Polyclonal antibodies can be prepared as described above by immunizing a suitable subject with a desired immunogen, e.g., polypeptide of the disclosure or a fragment thereof. The antibody titer in the immunized subject can be monitored over time by standard techniques, such as with an enzyme linked immunosorbent assay (ELISA) using immobilized polypeptide. If desired, the antibody molecules directed against the polypeptide can be isolated from the mammal (e.g., from the blood) and further purified by well-known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybridoma technique originally described by Kohler and Milstein, Nature 256:495-497 (1975), the human B cell hybridoma technique (Kozbor et al., Immunol. Today 4: 72 (1983)), the EBV-hybridoma technique (Cole et al., Monoclonal Antibodies and Cancer Therapy, Alan R. Liss (1985) Inc., pp. 77-96) or trioma techniques. The technology for producing hybridomas is well known (see generally Current Protocols in Immunology (1994) Coligan et al., (eds.) John Wiley & Sons, Inc., New York, N.Y.). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds a polypeptide of the disclosure.

Any of the many well known protocols used for fusing lymphocytes and immortalized cell lines can be applied for the purpose of generating a monoclonal antibody to a polypeptide of the disclosure (see, e.g., Current Protocols in Immunology, supra; Galfre et al., Nature 266:55052 (1977); R. H. Kenneth, in Monoclonal Antibodies: A New Dimension In Biological Analyses, Plenum Publishing Corp., New York, N.Y. (1980); and Lerner, Yale J. Biol. Med. 54:387-402 (1981)). Moreover, the ordinarily skilled worker can appreciate that there are many variations of such methods that also would be useful. Alternative to preparing monoclonal antibody-secreting hybridomas, a monoclonal antibody to a polypeptide of the disclosure can be identified and isolated by screening a recombinant combinatorial immunoglobulin library (e.g., an antibody phage display library) with the polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP$^a$ Phage Display Kit, Catalog No. 240612). Additionally, examples of methods and reagents particularly amenable for use in generating and screening antibody display library can be found in, for example, U.S. Pat. No. 5,223,409; PCT Publication Nos. WO 92/18619, WO 91/17271, WO 92/20791, WO 92/15679; WO 93/01288, WO 92/01047, WO 92/09690, and WO 90/02809; Fuchs et al., Bio/Technology 9: 1370-1372 (1991); Hay et al., Hum.

Antibod. Hybndomas 3:81-85 (1992); Huse et al., Science 246: 1275-1281 (1989); and Griffiths et al., EMBO J. 12:725-734 (1993).

Additionally, recombinant antibodies, such as chimeric and humanized monoclonal antibodies, comprising both human and non-human portions, which can be made using standard recombinant DNA techniques, are within the scope of the disclosure. Such chimeric and humanized monoclonal antibodies can be produced by recombinant DNA techniques known in the art.

In general, antibodies of the disclosure (e.g., a monoclonal antibody) can be used to isolate a polypeptide of the disclosure by standard techniques, such as affinity chromatography or immunoprecipitation. A polypeptide-specific antibody can facilitate the purification of natural polypeptide from cells and of recombinants produced polypeptide expressed in host cells Moreover, an antibody specific for a polypeptide of the disclosure can be used to detect the polypeptide (e.g., in a cellular lysate, cell supernatant, or tissue sample) in order to evaluate the abundance and pattern of expression of the polypeptide. Antibodies can be used diagnostically, prognostically, or theranostically to monitor protein levels in tissue as part of a clinical testing procedure, e.g., to, for example, determine the efficacy of a given treatment regimen. The antibody can be coupled to a detectable substance to facilitate its detection. Examples of detectable substances include various enzymes, prosthetic groups, fluorescent materials, luminescent materials, bioluminescent materials, and radioactive materials. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotnazinylamine fluorescein, dansyl chloride or phycoerythnn; an example of a luminescent material includes luminol; examples of bioluminescent materials include luciferase, luciferin, and aequorin, and examples of suitable radioactive material include $^{125}I$, $^{131}I$, $^{35}S$ or $^{3}H$. Antibodies can also be useful in pharmacogenomic analysis. In such embodiments, antibodies against variant proteins encoded by nucleic acids according to the disclosure, such as variant proteins that are encoded by nucleic acids that contain at least one genetic variation of the disclosure, can be used to identify individuals that require modified treatment modalities.

Antibodies can furthermore be useful for assessing expression of variant proteins in disease states, such as in active stages of a disease, or in an individual with a predisposition to a disease related to the function of the protein, in particular a developmental disorder. Antibodies specific for a variant protein of the present disclosure that is encoded by a nucleic acid that comprises at least one polymorphic marker or haplotype as described herein can be used to screen for the presence of the variant protein, for example, to screen for a predisposition to a developmental disorder as indicated by the presence of the variant protein.

Antibodies can be used in other methods. Thus, antibodies are useful as screening tools for evaluating proteins, such as variant proteins of the disclosure, in conjunction with analysis by electrophoretic mobility, isoelectric point, tryptic or other protease digest, or for use in other physical assays known to those skilled in the art. Antibodies can also be used in tissue typing. In one such embodiment, a specific variant protein has been correlated with expression in a specific tissue type, and antibodies specific for the variant protein can then be used to identify the specific tissue type.

Subcellular localization of proteins, including variant proteins, can also be determined using antibodies, and can be applied to assess aberrant subcellular localization of the protein in cells in various tissues. Such use can be applied in genetic testing, but also in monitoring a particular treatment modality. In the case where treatment is aimed at correcting the expression level or presence of the variant protein or aberrant tissue distribution or developmental expression of the variant protein, antibodies specific for the variant protein or fragments thereof can be used to monitor therapeutic efficacy.

Antibodies are further useful for inhibiting variant protein function, for example, by blocking the binding of a variant protein to a binding molecule or partner. Such uses can also be applied in a therapeutic context in which treatment involves inhibiting a variant protein's function. An antibody can be for example, be used to block or competitively inhibit binding, thereby modulating (i.e., agonizing or antagonizing) the activity of the protein. Antibodies can be prepared against specific protein fragments containing sites required for specific function or against an intact protein that is associated with a cell or cell membrane.

The present disclosure also embodies the use of any pharmacologic agent that can be conjugated to an antibody or an antibody binding fragment, and delivered in active form. Examples of such agents include cytotoxins, radioisotopes, hormones such as a steroid, anti-metabolites such as cytosines, and chemotherapeutic agents. Other embodiments can include agents such as a coagulant, a cytokine, growth factor, bacterial endotoxin or a moiety of bacterial endotoxin. The targeting antibody-based agent directs the toxin to, and thereby selectively modulates the cell expressing the targeted surface receptor. In some embodiments, therapeutic antibodies employ cross-linkers that provide high in vivo stability (Thorpe et al., Cancer Res., 48:6396, 1988). In any event, it is proposed that agents such as these can, if desired, be successfully conjugated to antibodies or antibody binding fragments, in a manner that will allow their targeting, internalization, release or presentation at the site of the targeted cells expressing the ASD associated biomarkers as required using known conjugation technology. For administration in vivo, for example, an antibody can be linked with an additional therapeutic payload, such as radionuclide, an enzyme, an immunogenic epitope, or a cytotoxic agent, including bacterial toxins (diphtheria or plant toxins, such as ricin). The in vivo half-life of an antibody or a fragment thereof can be increased by pegylation through conjugation to polyethylene glycol.

Gene Therapy

In some embodiments, gene therapy can be used as therapeutic to modulate a peptide sequence or RNA expressed from a gene associated with a developmental disorder. Gene therapy involves the use of DNA as a pharmaceutical agent to treat disease. DNA can be used to supplement or alter genes within an individual's cells as a therapy to treat disease. Gene therapy can be used to alter the signaling or function associated with the a developmental disorder associated biomarker, have an inhibitory or stimulatory effect on the developmental disorder associated biomarkers, or have a stimulatory or inhibitory effect on the expression or activity of the a developmental disorder associated biomarkers' ligands. In one embodiment, gene therapy involves using DNA that encodes a functional, therapeutic gene in order to replace a mutated gene. Other forms involve directly correcting a mutation, or using DNA that encodes a therapeutic protein drug (rather than a natural human gene) to provide treatment. DNA that encodes a therapeutic protein can be packaged within a vector, which can used to introduce the DNA inside cells within the body. Once inside, the DNA becomes expressed by the cell machinery, resulting in the production of the therapeutic, which in turn can treat the subject's disease.

Gene therapy agents and other agents for testing therapeutics can include plasmids, viral vectors, artificial chromosomes and the like containing therapeutic genes or polynucleotides encoding therapeutic products, including coding sequences for small interfering RNA (siRNA), ribozymes and antisense RNA, which in certain further embodiments can comprise an operably linked promoter such as a constitutive promoter or a regulatable promoter, such as an inducible promoter (e.g., IPTG inducible), a tightly regulated promoter (e.g., a promoter that permits little or no detectable transcription in the absence of its cognate inducer or derepressor) or a tissue-specific promoter. Methodologies for preparing, testing and using these and related agents are known in the art. See, e.g., Ausubel (Ed.), Current Protocols in Molecular Biology (2007 John Wiley & Sons, NY); Rosenzweig and Nabel (Eds), Current Protocols in Human Genetics (esp. Ch. 13 therein, "Delivery Systems for Gene Therapy", 2008 John Wiley & Sons, NY); Abell, Advances in Amino Acid Mimetics and Peptidomimetics, 1997 Elsevier, NY. In another embodiment, gene therapy agents may encompass zinc finger nuclease (ZFN) or transcription activator-like effector nuclease (TALEN) strategies, see for example: Urnov et al. (2010), Nature Reviews Genetics 11(9):636-46; Yusa et al. (2011), Nature 478(7369):391-4; Bedell et al. (2012), Nature ePub September 23, PubMed ID 23000899.

As a non-limiting example, one such embodiment contemplates introduction of a gene therapy agent for treating ASD (e.g., an engineered therapeutic virus, a therapeutic agent-carrying nanoparticle, etc.) to one or more injection sites in a subject, without the need for imaging, surgery, or histology on biopsy specimens. Of course, periodic monitoring of the circulation for leaked therapeutic agent and/or subsequent analysis of a biopsy specimen, e.g., to assess the effects of the agent on the target tissue, can also be considered. A gene therapy includes a therapeutic polynucleotide administered before, after, or at the same time as any other therapy described herein. In some embodiments, therapeutic genes may include an antisense version of a biomarker disclosed herein, a sequence of a biomarker described herein, or an inhibitor of a biomarker disclosed herein.

Methods of Treatment

Some embodiments of the present disclosure relates to methods of using pharmaceutical compositions and kits comprising agents that inhibit a developmental disorder associated biomarker or a developmental disorder associated biomarkers to inhibit or decrease a developmental disorder progression. Another embodiment of the present disclosure provides methods, pharmaceutical compositions, and kits for the treatment of animal subjects. The term "animal subject" as used herein includes humans as well as other mammals. The term "treating" as used herein includes achieving a therapeutic benefit and/or a prophylactic benefit. By therapeutic benefit is meant eradication or amelioration of the underlying viral infection. Also, a therapeutic benefit is achieved with the eradication or amelioration of one or more of the physiological symptoms associated a developmental disorder such that an improvement is observed in the animal subject, notwithstanding the fact that the animal subject can still be afflicted with a developmental disorder.

For embodiments where a prophylactic benefit is desired, a pharmaceutical composition of the disclosure can be administered to a subject at risk of developing a developmental disorder, or to a subject reporting one or more of the physiological symptoms of a developmental disorder, even though a screening of the condition cannot have been made. Administration can prevent a developmental disorder from developing, or it can reduce, lessen, shorten and/or otherwise ameliorate the progression of a developmental disorder, or symptoms that develop. The pharmaceutical composition can modulate or target a developmental disorder's associated biomarker. Wherein, the term modulate includes inhibition of a developmental disorder's associated biomarkers or alternatively activation of a developmental disorder associated biomarkers.

Reducing the activity of a developmental disorder's associated biomarkers, is also referred to as "inhibiting" the developmental disorder's associated biomarkers. The term "inhibits" and its grammatical conjugations, such as "inhibitory," do not require complete inhibition, but refer to a reduction in a developmental disorder's associated biomarkers' activities. In some embodiments such reduction is by at least 5%, at least 10%, at least 20%, at least 30%, at least 40%, at least 50%, at least 75%, at least 90%, and can be by at least 95% of the activity of the enzyme or other biologically important molecular process in the absence of the inhibitory effect, e.g., in the absence of an inhibitor. Conversely, the phrase "does not inhibit" and its grammatical conjugations refer to situations where there is less than 20%, less than 10%, and can be less than 5%, of reduction in enzyme activity in the presence of the agent. Further the phrase "does not substantially inhibit" and its grammatical conjugations refer to situations where there is less than 30%, less than 20%, and in some embodiments less than 10% of reduction in enzyme or other biologically important molecular activity in the presence of the agent.

Increasing the activity a developmental disorder's associated biomarkers is also referred to as "activating" the developmental disorder's associated biomarkers. The term "activated" and its grammatical conjugations, such as "activating," do not require complete activation, but refer to an increase in a developmental disorder associated biomarkers' activities. In some embodiments such increase is by at least 5%, at least 10%, at least 20%, at least 30%, at least 40%, at least 50%, at least 60%, at least 70%, at least 75%, at least 80%, at least 85%, at least 90%, and can be by at least 95% of the activity of the enzyme or other biologically important molecular process in the absence of the activation effect, e.g., in the absence of an activator. Conversely, the phrase "does not activate" and its grammatical conjugations refer to situations where there can be less than 20%, less than 10%, and less than 5%, of an increase in enzyme or other biologically important molecular activity in the presence of the agent. Further the phrase "does not substantially activate" and its grammatical conjugations refer to situations where there is less than 30%, less than 20%, and in some embodiments less than 10% of an increase in enzyme or other biologically important molecular activity in the presence of the agent.

The ability to reduce enzyme or other biologically important molecular activity is a measure of the potency or the activity of an agent, or combination of agents, towards or against the enzyme or other biologically important molecular process. Potency can be measured by cell free, whole cell and/or in vivo assays in terms of IC50, Ki and/or ED50 values. An IC50 value represents the concentration of an agent required to inhibit enzyme activity by half (50%) under a given set of conditions. A Ki value represents the equilibrium affinity constant for the binding of an inhibiting agent to the enzyme or other relevant biomolecule. An ED50 value represents the dose of an agent required to affect a half-maximal response in a biological assay. Further details of these measures will be appreciated by those of ordinary skill in the art, and can be found in standard texts on biochemistry, enzymology, and the like.

The present disclosure also includes kits that can be used to treat developmental disorders. These kits comprise an agent or combination of agents that inhibits a developmental disorder associated biomarker or a developmental disorder's associated biomarkers and in some embodiments instructions teaching the use of the kit according to the various methods and approaches described herein. Such kits can also include information, such as scientific literature references, package insert materials, clinical trial results, and/or summaries of these and the like, which indicate or establish the activities and/or advantages of the agent. Such information can be based on the results of various studies, for example, studies using experimental animals involving in vivo models and studies based on human clinical trials. Kits described herein can be provided, marketed and/or promoted to health providers, including physicians, nurses, pharmacists, formulary officials, and the like.

In some aspects a host cell can be used for testing or administering therapeutics. In some embodiments, a host cell can comprise a nucleic acid comprising expression control sequences operably-linked to a coding region. The host cell can be natural or non-natural. The non-natural host used in aspects of the method can be any cell capable of expressing a nucleic acid of the disclosure including, bacterial cells, fungal cells, insect cells, mammalian cells and plant cells. In some aspects the natural host is a mammalian tissue cell and the non-natural host is a different mammalian tissue cell. Other aspects of the method include a natural host that is a first cell normally residing in a first mammalian species and the non-natural host is a second cell normally residing in a second mammalian species. In another alternative aspect, the method uses a first cell and the second cell that are from the same tissue type. In those aspects of the method where the coding region encodes a mammalian protein, the mammalian protein may be a hormone. In other aspects the coding region may encode a neuropeptide, an antibody, an antimetabolites or a protein or nucleotide therapeutic.

Expression control sequence scan be those nucleotide sequences, both 5' and 3' to a coding region, that are required for the transcription and translation of the coding region in a host organism. Regulatory sequences include a promoter, ribosome binding site, optional inducible elements and sequence elements required for efficient 3' processing, including polyadenylation. When the structural gene has been isolated from genomic DNA, the regulatory sequences also include those intronic sequences required for splicing of the introns as part of mRNA formation in the target host.

Formulations, Routes of Administration, and Effective Doses

Yet another aspect of the present disclosure relates to formulations, routes of administration and effective doses for pharmaceutical compositions comprising an agent or combination of agents of the instant disclosure. Such pharmaceutical compositions can be used to treat a developmental disorder progression and a developmental disorder associated symptoms as described above.

Compounds of the disclosure can be administered as pharmaceutical formulations including those suitable for oral (including buccal and sub-lingual), rectal, nasal, topical, transdermal patch, pulmonary, vaginal, suppository, or parenteral (including intramuscular, intraarterial, intrathecal, intradermal, intraperitoneal, subcutaneous and intravenous) administration or in a form suitable for administration by aerosolization, inhalation or insufflation. General information on drug delivery systems can be found in Ansel et al., Pharmaceutical Dosage Forms and Drug Delivery Systems (Lippencott Williams & Wilkins, Baltimore Md. (1999).

In various embodiments, the pharmaceutical composition includes carriers and excipients (including but not limited to buffers, carbohydrates, mannitol, proteins, polypeptides or amino acids such as glycine, antioxidants, bacteriostats, chelating agents, suspending agents, thickening agents and/or preservatives), water, oils including those of petroleum, animal, vegetable or synthetic origin, such as peanut oil, soybean oil, mineral oil, sesame oil and the like, saline solutions, aqueous dextrose and glycerol solutions, flavoring agents, coloring agents, detackifiers and other acceptable additives, adjuvants, or binders, other pharmaceutically acceptable auxiliary substances as required to approximate physiological conditions, such as pH buffering agents, tonicity adjusting agents, emulsifying agents, wetting agents and the like. Examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. In some embodiments, the pharmaceutical preparation is substantially free of preservatives. In other embodiments, the pharmaceutical preparation can contain at least one preservative. General methodology on pharmaceutical dosage forms is found in Ansel et al., Pharmaceutical Dosage Forms and Drug Delivery Systems (Lippencott, Williams, & Wilkins, Baltimore Md. (1999)). It will be recognized that, while any suitable carrier known to those of ordinary skill in the art can be employed to administer the compositions of this disclosure, the type of carrier will vary depending on the mode of administration.

Compounds can also be encapsulated within liposomes using well-known technology. Biodegradable microspheres can also be employed as carriers for the pharmaceutical compositions of this disclosure. Suitable biodegradable microspheres are disclosed, for example, in U.S. Pat. Nos. 4,897,268, 5,075,109, 5,928,647, 5,811,128, 5,820,883, 5,853,763, 5,814,344 and 5,942,252.

The compound can be administered in liposomes or microspheres (or microparticles). Methods for preparing liposomes and microspheres for administration to a subject are well known to those of skill in the art. U.S. Pat. No. 4,789,734, the contents of which are hereby incorporated by reference, describes methods for encapsulating biological materials in liposomes. Essentially, the material is dissolved in an aqueous solution, the appropriate phospholipids and lipids added, along with surfactants if required, and the material dialyzed or sonicated, as necessary. A review of known methods is provided by G. Gregoriadis, Chapter 14, "Liposomes," Drug Carriers in Biology and Medicine, pp. 2.sup. 87-341 (Academic Press, 1979).

Microspheres formed of polymers or proteins are well known to those skilled in the art, and can be tailored for passage through the gastrointestinal tract directly into the blood stream. Alternatively, the compound can be incorporated and the microspheres, or composite of microspheres, implanted for slow release over a period of time ranging from days to months. See, for example, U.S. Pat. Nos. 4,906,474, 4,925,673 and 3,625,214, and Jein, TIPS 19:155-157 (1998), the contents of which are hereby incorporated by reference.

The concentration of drug can be adjusted, the pH of the solution buffered and the isotonicity adjusted to be compatible with intravenous injection, as is well known in the art.

The compounds of the disclosure can be formulated as a sterile solution or suspension, in suitable vehicles, well known in the art. The pharmaceutical compositions can be sterilized by conventional, well-known sterilization techniques, or can be sterile filtered. The resulting aqueous solutions can be packaged for use as is, or lyophilized, the lyophilized preparation being combined with a sterile solution prior to administration. Suitable formulations and additional carriers are described in Remington "The Science and Practice of Pharmacy" (20th Ed., Lippincott Williams & Wilkins, Baltimore Md.), the teachings of which are incorporated by reference in their entirety herein.

The agents or their pharmaceutically acceptable salts can be provided alone or in combination with one or more other agents or with one or more other forms. For example, a formulation can comprise one or more agents in particular proportions, depending on the relative potencies of each agent and the intended indication. For example, in compositions for targeting two different host targets, and where potencies are similar, about a 1:1 ratio of agents can be used. The two forms can be formulated together, in the same dosage unit e.g., in one cream, suppository, tablet, capsule, aerosol spray, or packet of powder to be dissolved in a beverage; or each form can be formulated in a separate unit, e.g., two creams, two suppositories, two tablets, two capsules, a tablet and a liquid for dissolving the tablet, two aerosol sprays, or a packet of powder and a liquid for dissolving the powder, etc.

The term "pharmaceutically acceptable salt" means those salts which retain the biological effectiveness and properties of the agents used in the present disclosure, and which are not biologically or otherwise undesirable. For example, a pharmaceutically acceptable salt does not interfere with the beneficial effect of an agent of the disclosure in inhibiting a developmental disorder associated biomarkers' components Typical salts are those of the inorganic ions, such as, for example, sodium, potassium, calcium, magnesium ions, and the like. Such salts include salts with inorganic or organic acids, such as hydrochloric acid, hydrobromic acid, phosphoric acid, nitric acid, sulfuric acid, methanesulfonic acid, p toluenesulfonic acid, acetic acid, fumaric acid, succinic acid, lactic acid, mandelic acid, malic acid, citric acid, tartaric acid or maleic acid. In addition, if the agent(s) contain a carboxy group or other acidic group, it can be converted into a pharmaceutically acceptable addition salt with inorganic or organic bases. Examples of suitable bases include sodium hydroxide, potassium hydroxide, ammonia, cyclohexylamine, dicyclohexyl-amine, ethanolamine, diethanolamine, triethanolamine, and the like.

A pharmaceutically acceptable ester or amide refers to those which retain biological effectiveness and properties of the agents used in the present disclosure, and which are not biologically or otherwise undesirable. For example, the ester or amide does not interfere with the beneficial effect of an agent of the disclosure in inhibiting a developmental disorder associated biomarkers' components. Typical esters include ethyl, methyl, isobutyl, ethylene glycol, and the like. Typical amides include unsubstituted amides, alkyl amides, dialkyl amides, and the like.

In some embodiments, an agent can be administered in combination with one or more other compounds, forms, and/or agents, e.g., as described above. Pharmaceutical compositions comprising combinations of a developmental disorder associated biomarkers' inhibitors with one or more other active agents can be formulated to comprise certain molar ratios. For example, molar ratios of about 99:1 to about 1:99 of a developmental disorder's associated biomarkers' inhibitors to the other active agent can be used. In some subset of the embodiments, the range of molar ratios of developmental disorder's associated biomarkers' inhibitors: other active agents are selected from about 80:20 to about 20:80; about 75:25 to about 25:75, about 70:30 to about 30:70, about 66:33 to about 33:66, about 60:40 to about 40:60; about 50:50; and about 90:10 to about 10:90. The molar ratio of a developmental disorder's associated biomarkers' inhibitors: other active agents can be about 1:9, and in some embodiments can be about 1:1. The two agents, forms and/or compounds can be formulated together, in the same dosage unit e.g., in one cream, suppository, tablet, capsule, or packet of powder to be dissolved in a beverage; or each agent, form, and/or compound can be formulated in separate units, e.g., two creams, suppositories, tablets, two capsules, a tablet and a liquid for dissolving the tablet, an aerosol spray a packet of powder and a liquid for dissolving the powder, etc.

If necessary or desirable, the agents and/or combinations of agents can be administered with still other agents. The choice of agents that can be co-administered with the agents and/or combinations of agents of the instant disclosure can depend, at least in part, on the condition being treated. Agents of particular use in the formulations of the present disclosure include, for example, any agent having a therapeutic effect for a viral infection, including, e.g., drugs used to treat inflammatory conditions. For example, in treatments for influenza, in some embodiments formulations of the instant disclosure can additionally contain one or more conventional anti-inflammatory drugs, such as an NSAID, e.g., ibuprofen, naproxen, acetaminophen, ketoprofen, or aspirin. In some alternative embodiments for the treatment of influenza formulations of the instant disclosure can additionally contain one or more conventional influenza antiviral agents, such as amantadine, rimantadine, zanamivir, and oseltamivir. In treatments for retroviral infections, such as HIV, formulations of the instant disclosure can additionally contain one or more conventional antiviral drug, such as protease inhibitors (lopinavir/ritonavir {Kaletra}, indinavir {Crixivan}, ritonavir {Norvir}, nelfinavir {Viracept}, saquinavir hard gel capsules {Invirase}, atazanavir {Reyataz}, amprenavir {Agenerase}, fosamprenavir {Telzir}, tipranavir {Aptivus}), reverse transcriptase inhibitors, including non-Nucleoside and Nucleoside/nucleotide inhibitors (AZT {zidovudine, Retrovir}, ddI {didanosine, Videx}, 3TC {lamivudine, Epivir}, d4T {stavudine, Zerit}, abacavir {Ziagen}, FTC {emtricitabine, Emtriva}, tenofovir {Viread}, efavirenz {Sustiva} and nevirapine {Viramune}), fusion inhibitors T20 {enfuvirtide, Fuzeon}, integrase inhibitors (MK-0518 and GS-9137), and maturation inhibitors (PA-457 {Bevirimat}). As another example, formulations can additionally contain one or more supplements, such as vitamin C, E or other anti-oxidants.

The agent(s) (or pharmaceutically acceptable salts, esters or amides thereof) can be administered per se or in the form of a pharmaceutical composition wherein the active agent(s) is in an admixture or mixture with one or more pharmaceutically acceptable carriers. A pharmaceutical composition, as used herein, can be any composition prepared for administration to a subject. Pharmaceutical compositions for use in accordance with the present disclosure can be formulated in conventional manner using one or more physiologically acceptable carriers, comprising excipients, diluents, and/or auxiliaries, e.g., which facilitate processing of the active agents into preparations that can be administered. Proper formulation can depend at least in part upon the route of administration chosen. The agent(s) useful in the present disclosure, or pharmaceutically acceptable salts, esters, or amides thereof, can be delivered to a subject using a number of routes or modes of administration, including oral, buccal, topical, rectal, transdermal, transmucosal, subcutaneous, intravenous, and intramuscular applications, as well as by inhalation.

For oral administration, the agents can be formulated readily by combining the active agent(s) with pharmaceutically acceptable carriers well known in the art. Such carriers enable the agents of the disclosure to be formulated as tablets, including chewable tablets, pills, dragees, capsules, lozenges, hard candy, liquids, gels, syrups, slurries, powders, suspensions, elixirs, wafers, and the like, for oral ingestion by a subject to be treated. Such formulations can comprise pharmaceutically acceptable carriers including solid diluents or fillers, sterile aqueous media and various non-toxic organic solvents. A solid carrier can be one or more substances which can also act as diluents, flavoring agents, solubilizers, lubricants, suspending agents, binders, preservatives, tablet disintegrating agents, or an encapsulating material. In powders, the carrier generally is a finely divided solid which is a mixture with the finely divided active component. In tablets, the active component generally is mixed with the carrier having the necessary binding capacity in suitable proportions and compacted in the shape and size desired. The powders and tablets preferably contain from about one (1) to about seventy (70) percent of the active compound. Suitable carriers include but are not limited to magnesium carbonate, magnesium stearate, talc, sugar, lactose, pectin, dextrin, starch, gelatin, tragacanth, methylcellulose, sodium carboxymethylcellulose, a low melting wax, cocoa butter, and the like. Generally, the agents of the disclosure will be included at concentration levels ranging from about 0.5%, about 5%, about 10%, about 20%, or about 30% to about 50%, about 60%, about 70%, about 80% or about 90% by weight of the total composition of oral dosage forms, in an amount sufficient to provide a desired unit of dosage.

Aqueous suspensions for oral use can contain agent(s) of this disclosure with pharmaceutically acceptable excipients, such as a suspending agent (e.g., methyl cellulose), a wetting agent (e.g., lecithin, lysolecithin and/or a long-chain fatty alcohol), as well as coloring agents, preservatives, flavoring agents, and the like.

In some embodiments, oils or non-aqueous solvents can be required to bring the agents into solution, due to, for example, the presence of large lipophilic moieties. Alternatively, emulsions, suspensions, or other preparations, for example, liposomal preparations, can be used. With respect to liposomal preparations, any known methods for preparing liposomes for treatment of a condition can be used. See, for example, Bangham et al., J. Mol. Biol. 23: 238-252 (1965) and Szoka et al., Proc. Natl Acad. Sci. USA 75: 4194-4198 (1978), incorporated herein by reference. Ligands can also be attached to the liposomes to direct these compositions to particular sites of action. Agents of this disclosure can also be integrated into foodstuffs, e.g., cream cheese, butter, salad dressing, or ice cream to facilitate solubilization, administration, and/or compliance in certain subject populations.

Pharmaceutical preparations for oral use can be obtained as a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; flavoring elements, cellulose preparations such as, for example, maize starch, wheat starch, rice starch, potato starch, gelatin, gum tragacanth, methyl cellulose, hydroxypropylmethyl cellulose, sodium carboxymethylcellulose, and/or polyvinyl pyrrolidone (PVP). If desired, disintegrating agents can be added, such as the cross linked polyvinyl pyrrolidone, agar, or alginic acid or a salt thereof such as sodium alginate. The agents can also be formulated as a sustained release preparation.

Dragee cores can be provided with suitable coatings. For this purpose, concentrated sugar solutions can be used, which can optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments can be added to the tablets or dragee coatings for identification or to characterize different combinations of active agents.

Pharmaceutical preparations that can be used orally include push fit capsules made of gelatin, as well as soft, sealed capsules made of gelatin and a plasticizer, such as glycerol or sorbitol. The push fit capsules can contain the active ingredients in admixture with filler such as lactose, binders such as starches, and/or lubricants such as talc or magnesium stearate and, optionally, stabilizers. In soft capsules, the active agents can be dissolved or suspended in suitable liquids, such as fatty oils, liquid paraffin, or liquid polyethylene glycols. In addition, stabilizers can be added. All formulations for oral administration should be in dosages suitable for administration.

Other forms suitable for oral administration include liquid form preparations including emulsions, syrups, elixirs, aqueous solutions, aqueous suspensions, or solid form preparations which are intended to be converted shortly before use to liquid form preparations. Emulsions can be prepared in solutions, for example, in aqueous propylene glycol solutions or can contain emulsifying agents, for example, such as lecithin, sorbitan monooleate, or acacia. Aqueous solutions can be prepared by dissolving the active component in water and adding suitable colorants, flavors, stabilizers, and thickening agents. Aqueous suspensions can be prepared by dispersing the finely divided active component in water with viscous material, such as natural or synthetic gums, resins, methylcellulose, sodium carboxymethylcellulose, and other well known suspending agents. Suitable fillers or carriers with which the compositions can be administered include agar, alcohol, fats, lactose, starch, cellulose derivatives, polysaccharides, polyvinylpyrrolidone, silica, sterile saline and the like, or mixtures thereof used in suitable amounts. Solid form preparations include solutions, suspensions, and emulsions, and can contain, in addition to the active component, colorants, flavors, stabilizers, buffers, artificial and natural sweeteners, dispersants, thickeners, solubilizing agents, and the like.

A syrup or suspension can be made by adding the active compound to a concentrated, aqueous solution of a sugar, e.g., sucrose, to which can also be added any accessory ingredients. Such accessory ingredients can include flavoring, an agent to retard crystallization of the sugar or an agent to increase the solubility of any other ingredient, e.g., as a polyhydric alcohol, for example, glycerol or sorbitol.

When formulating compounds of the disclosure for oral administration, it can be desirable to utilize gastroretentive formulations to enhance absorption from the gastrointestinal (GI) tract. A formulation which is retained in the stomach for several hours can release compounds of the disclosure slowly and provide a sustained release that can be preferred in some embodiments of the disclosure. Disclosure of such gastro-retentive formulations are found in Klausner, E. A.; Lavy, E.; Barta, M.; Cserepes, E.; Friedman, M.; Hoffman, A. 2003 "Novel gastroretentive dosage forms: evaluation of gastroretentivity and its effect on levodopa in humans." Pharm. Res. 20, 1466-73, Hoffman, A.; Stepensky, D.; Lavy, E.; Eyal, S. Klausner, E.; Friedman, M. 2004 "Pharmacokinetic and pharmacodynamic aspects of gastroretentive dosage forms" Int. J. Pharm. 11, 141-53, Streubel, A.; Siepmann, J.; Bodmeier, R.; 2006 "Gastroretentive drug delivery systems" Expert Opin. Drug Deliver. 3, 217-3, and Chavanpatil, M. D.; Jain, P.; Chaudhari, S.; Shear, R.; Vavia, P. R. "Novel sustained release, swellable and bioadhesive gastroretentive drug delivery system for olfoxacin" Int. J. Pharm. 2006. Expandable, floating and bioadhesive techniques can be utilized to maximize absorption of the compounds of the disclosure.

The compounds of the disclosure can be formulated for parenteral administration (e.g., by injection, for example, bolus injection or continuous infusion) and can be presented in unit dose form in ampoules, pre-filled syringes, small volume infusion or in multi-dose containers with an added preservative. The compositions can take such forms as suspensions, solutions, or emulsions in oily or aqueous vehicles, for example, solutions in aqueous polyethylene glycol.

For injectable formulations, the vehicle can be chosen from those known in art to be suitable, including aqueous solutions or oil suspensions, or emulsions, with sesame oil, corn oil, cottonseed oil, or peanut oil, as well as elixirs, mannitol, dextrose, or a sterile aqueous solution, and similar pharmaceutical vehicles. The formulation can also comprise polymer compositions which are biocompatible, biodegradable, such as poly(lactic-co-glycolic)acid. These materials can be made into micro or nanospheres, loaded with drug and further coated or derivatized to provide superior sustained release performance. Vehicles suitable for periocular or intraocular injection include, for example, suspensions of therapeutic agent in injection grade water, liposomes and vehicles suitable for lipophilic substances. Other vehicles for periocular or intraocular injection are well known in the art.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition can also include a solubilizing agent and a local anesthetic such as lidocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients can be mixed prior to administration.

When administration is by injection, the active compound can be formulated in aqueous solutions, specifically in physiologically compatible buffers such as Hanks solution, Ringer's solution, or physiological saline buffer. The solution can contain formulatory agents such as suspending, stabilizing and/or dispersing agents. Alternatively, the active compound can be in powder form for constitution with a suitable vehicle, e.g., sterile pyrogen-free water, before use. In some embodiments, the pharmaceutical composition does not comprise an adjuvant or any other substance added to enhance the immune response stimulated by the peptide. In some embodiments, the pharmaceutical composition comprises a substance that inhibits an immune response to the peptide. Methods of formulation are known in the art, for example, as disclosed in Remington's Pharmaceutical Sciences, latest edition, Mack Publishing Co., Easton P.

In addition to the formulations described previously, the agents can also be formulated as a depot preparation. Such long acting formulations can be administered by implantation or transcutaneous delivery (for example, subcutaneously or intramuscularly), intramuscular injection or use of a transdermal patch. Thus, for example, the agents can be formulated with suitable polymeric or hydrophobic materials (for example, as an emulsion in an acceptable oil) or ion exchange resins, or as sparingly soluble derivatives, for example, as a sparingly soluble salt.

In some embodiments, pharmaceutical compositions comprising one or more agents of the present disclosure exert local and regional effects when administered topically or injected at or near particular sites of infection. Direct topical application, e.g., of a viscous liquid, solution, suspension, dimethylsulfoxide (DMSO)-based solutions, liposomal formulations, gel, jelly, cream, lotion, ointment, suppository, foam, or aerosol spray, can be used for local administration, to produce for example, local and/or regional effects. Pharmaceutically appropriate vehicles for such formulation include, for example, lower aliphatic alcohols, polyglycols (e.g., glycerol or polyethylene glycol), esters of fatty acids, oils, fats, silicones, and the like. Such preparations can also include preservatives (e.g., p-hydroxybenzoic acid esters) and/or antioxidants (e.g., ascorbic acid and tocopherol). See also Dermatological Formulations: Percutaneous absorption, Barry (Ed.), Marcel Dekker Incl, 1983.

Pharmaceutical compositions of the present disclosure can contain a cosmetically or dermatologically acceptable carrier. Such carriers are compatible with skin, nails, mucous membranes, tissues and/or hair, and can include any conventionally used cosmetic or dermatological carrier meeting these requirements. Such carriers can be readily selected by one of ordinary skill in the art. In formulating skin ointments, an agent or combination of agents of the instant disclosure can be formulated in an oleaginous hydrocarbon base, an anhydrous absorption base, a water-in-oil absorption base, an oil-in-water water-removable base and/or a water-soluble base. Examples of such carriers and excipients include, but are not limited to, humectants (e.g., urea), glycols (e.g., propylene glycol), alcohols (e.g., ethanol), fatty acids (e.g., oleic acid), surfactants (e.g., isopropyl myristate and sodium lauryl sulfate), pyrrolidones, glycerol monolaurate, sulfoxides, terpenes (e.g., menthol), amines, amides, alkanes, alkanols, water, calcium carbonate, calcium phosphate, various sugars, starches, cellulose derivatives, gelatin, and polymers such as polyethylene glycols.

Ointments and creams can, for example, be formulated with an aqueous or oily base with the addition of suitable thickening and/or gelling agents. Lotions can be formulated with an aqueous or oily base and will in general also containing one or more emulsifying agents, stabilizing agents, dispersing agents, suspending agents, thickening agents, or coloring agents. The construction and use of transdermal patches for the delivery of pharmaceutical agents is well known in the art. See, e.g., U.S. Pat. Nos.

5,023,252, 4,992,445 and 5,001,139. Such patches can be constructed for continuous, pulsatile, or on demand delivery of pharmaceutical agents.

Lubricants which can be used to form pharmaceutical compositions and dosage forms of the disclosure include, but are not limited to, calcium stearate, magnesium stearate, mineral oil, light mineral oil, glycerin, sorbitol, mannitol, polyethylene glycol, other glycols, stearic acid, sodium lauryl sulfate, talc, hydrogenated vegetable oil (e.g., peanut oil, cottonseed oil, sunflower oil, sesame oil, olive oil, corn oil, and soybean oil), zinc stearate, ethyl oleate, ethyl laureate, agar, or mixtures thereof. Additional lubricants include, for example, a syloid silica gel, a coagulated aerosol of synthetic silica, or mixtures thereof. A lubricant can optionally be added, in an amount of less than about 1 weight percent of the pharmaceutical composition.

The compositions according to the present disclosure can be in any form suitable for topical application, including aqueous, aqueous-alcoholic or oily solutions, lotion or serum dispersions, aqueous, anhydrous or oily gels, emulsions obtained by dispersion of a fatty phase in an aqueous phase (O/W or oil in water) or, conversely, (W/O or water in oil), microemulsions or alternatively microcapsules, microparticles or lipid vesicle dispersions of ionic and/or nonionic type. These compositions can be prepared according to conventional methods. Other than the agents of the disclosure, the amounts of the various constituents of the compositions according to the disclosure are those conventionally used in the art. These compositions in particular constitute protection, treatment or care creams, milks, lotions, gels or foams for the face, for the hands, for the body and/or for the mucous membranes, or for cleansing the skin. The compositions can also consist of solid preparations constituting soaps or cleansing bars.

Compositions of the present disclosure can also contain adjuvants common to the cosmetic and dermatological fields, such as hydrophilic or lipophilic gelling agents, hydrophilic or lipophilic active agents, preserving agents, antioxidants, solvents, fragrances, fillers, sunscreens, odor-absorbers and dyestuffs. The amounts of these various adjuvants are those conventionally used in the fields considered and, for example, are from about 0.01% to about 20% of the total weight of the composition. Depending on their nature, these adjuvants can be introduced into the fatty phase, into the aqueous phase and/or into the lipid vesicles.

In some embodiments, ocular viral infections can be effectively treated with ophthalmic solutions, suspensions, ointments or inserts comprising an agent or combination of agents of the present disclosure. Eye drops can be prepared by dissolving the active ingredient in a sterile aqueous solution such as physiological saline, buffering solution, etc., or by combining powder compositions to be dissolved before use. Other vehicles can be chosen, as is known in the art, including but not limited to: balance salt solution, saline solution, water soluble polyethers such as polyethyene glycol, polyvinyls, such as polyvinyl alcohol and povidone, cellulose derivatives such as methylcellulose and hydroxypropyl methylcellulose, petroleum derivatives such as mineral oil and white petrolatum, animal fats such as lanolin, polymers of acrylic acid such as carboxypolymethylene gel, vegetable fats such as peanut oil and polysaccharides such as dextrans, and glycosaminoglycans such as sodium hyaluronate. If desired, additives ordinarily used in the eye drops can be added. Such additives include isotonizing agents (e.g., sodium chloride, etc.), buffer agent (e.g., boric acid, sodium monohydrogen phosphate, sodium dihydrogen phosphate, etc.), preservatives (e.g., benzalkonium chloride, benzethonium chloride, chlorobutanol, etc.), thickeners (e.g., saccharide such as lactose, mannitol, maltose, etc.; e.g., hyaluronic acid or its salt such as sodium hyaluronate, potassium hyaluronate, etc.; e.g., mucopolysaccharide such as chondroitin sulfate, etc.; e.g., sodium polyacrylate, carboxyvinyl polymer, crosslinked polyacrylate, polyvinyl alcohol, polyvinyl pyrrolidone, methyl cellulose, hydroxy propyl methylcellulose, hydroxyethyl cellulose, carboxymethyl cellulose, hydroxy propyl cellulose or other agents known to those skilled in the art).

The solubility of the components of the present compositions can be enhanced by a surfactant or other appropriate co-solvent in the composition. Such cosolvents include polysorbate 20, 60, and 80, Pluronic F68, F-84 and P-103, cyclodextrin, or other agents known to those skilled in the art. Such co-solvents can be employed at a level of from about 0.01% to 2% by weight.

The compositions of the disclosure can be packaged in multidose form. Preservatives can be preferred to prevent microbial contamination during use. Suitable preservatives include: benzalkonium chloride, thimerosal, chlorobutanol, methyl paraben, propyl paraben, phenylethyl alcohol, edetate disodium, sorbic acid, Onamer M, or other agents known to those skilled in the art. In the prior art ophthalmic products, such preservatives can be employed at a level of from 0.004% to 0.02%. In the compositions of the present application the preservative, preferably benzalkonium chloride, can be employed at a level of from 0.001% to less than 0.01%, e.g. from 0.001% to 0.008%, preferably about 0.005% by weight. It has been found that a concentration of benzalkonium chloride of 0.005% can be sufficient to preserve the compositions of the present disclosure from microbial attack.

In some embodiments, developmental disorder associated symptoms of the ear can be effectively treated with otic solutions, suspensions, ointments or inserts comprising an agent or combination of agents of the present disclosure.

In some embodiments, the agents of the present disclosure are delivered in soluble rather than suspension form, which allows for more rapid and quantitative absorption to the sites of action. In general, formulations such as jellies, creams, lotions, suppositories and ointments can provide an area with more extended exposure to the agents of the present disclosure, while formulations in solution, e.g., sprays, provide more immediate, short-term exposure.

In some embodiments relating to topical/local application, the pharmaceutical compositions can include one or more penetration enhancers. For example, the formulations can comprise suitable solid or gel phase carriers or excipients that increase penetration or help delivery of agents or combinations of agents of the disclosure across a permeability barrier, e.g., the skin. Many of these penetration-enhancing compounds are known in the art of topical formulation, and include, e.g., water, alcohols (e.g., terpenes like methanol, ethanol, 2-propanol), sulfoxides (e.g., dimethyl sulfoxide, decylmethyl sulfoxide, tetradecylmethyl sulfoxide), pyrrolidones (e.g., 2-pyrrolidone, N-methyl-2-pyrrolidone, N-(2-hydroxyethyl)pyrrolidone), laurocapram, acetone, dimethylacetamide, dimethylformamide, tetrahydrofurfuryl alcohol, L-α-amino acids, anionic, cationic, amphoteric or nonionic surfactants (e.g., isopropyl myristate and sodium lauryl sulfate), fatty acids, fatty alcohols (e.g., oleic acid), amines, amides, clofibric acid amides, hexamethylene lauramide, proteolytic enzymes, α-bisabolol, d-limonene, urea and N,N-diethyl-m-toluamide, and the like. Additional examples include humectants (e.g., urea), glycols (e.g., propylene glycol and polyethylene glycol), glycerol monolaurate, alkanes, alkanols, ORGELASE, calcium carbonate, calcium phosphate, various sugars, starches, cellulose derivatives, gelatin, and/or other polymers. In some embodiments, the pharmaceutical compositions will include one or more such penetration enhancers.

In some embodiments, the pharmaceutical compositions for local/topical application can include one or more antimicrobial preservatives such as quaternary ammonium compounds, organic mercurials, p-hydroxy benzoates, aromatic alcohols, chlorobutanol, and the like.

Gastrointestinal developmental disorder symptoms can be effectively treated with orally- or rectally delivered solutions, suspensions, ointments, enemas and/or suppositories comprising an agent or combination of agents of the present disclosure.

Respiratory developmental disorder symptoms can be effectively treated with aerosol solutions, suspensions or dry powders comprising an agent or combination of agents of the present disclosure. Administration by inhalation is particularly useful in treating viral infections of the lung, such as influenza. The aerosol can be administered through the respiratory system or nasal passages. For example, one skilled in the art will recognize that a composition of the present disclosure can be suspended or dissolved in an appropriate carrier, e.g., a pharmaceutically acceptable propellant, and administered directly into the lungs using a nasal spray or inhalant. For example, an aerosol formulation comprising a developmental disorder associated biomarkers' inhibitors can be dissolved, suspended or emulsified in a propellant or a mixture of solvent and propellant, e.g., for administration as a nasal spray or inhalant. Aerosol formulations can contain any acceptable propellant under pressure, such as a cosmetically or dermatologically or pharmaceutically acceptable propellant, as conventionally used in the art.

An aerosol formulation for nasal administration is generally an aqueous solution designed to be administered to the nasal passages in drops or sprays. Nasal solutions can be similar to nasal secretions in that they are generally isotonic and slightly buffered to maintain a pH of about 5.5 to about 6.5, although pH values outside of this range can additionally be used. Antimicrobial agents or preservatives can also be included in the formulation.

An aerosol formulation for inhalations and inhalants can be designed so that the agent or combination of agents of the present disclosure is carried into the respiratory tree of the subject when administered by the nasal or oral respiratory route. Inhalation solutions can be administered, for example, by a nebulizer. Inhalations or insufflations, comprising finely powdered or liquid drugs, can be delivered to the respiratory system as a pharmaceutical aerosol of a solution or suspension of the agent or combination of agents in a propellant, e.g., to aid in disbursement. Propellants can be liquefied gases, including halocarbons, for example, fluorocarbons such as fluorinated chlorinated hydrocarbons, hydrochlorofluorocarbons, and hydrochlorocarbons, as well as hydrocarbons and hydrocarbon ethers.

Halocarbon propellants useful in the present disclosure include fluorocarbon propellants in which all hydrogens are replaced with fluorine, chlorofluorocarbon propellants in which all hydrogens are replaced with chlorine and at least one fluorine, hydrogen-containing fluorocarbon propellants, and hydrogen-containing chlorofluorocarbon propellants. Halocarbon propellants are described in Johnson, U.S. Pat. No. 5,376,359; Byron et al., U.S. Pat. No. 5,190,029; and Purewal et al., U.S. Pat. No. 5,776,434. Hydrocarbon propellants useful in the disclosure include, for example, propane, isobutane, n-butane, pentane, isopentane and neopentane. A blend of hydrocarbons can also be used as a propellant. Ether propellants include, for example, dimethyl ether as well as the ethers. An aerosol formulation of the disclosure can also comprise more than one propellant. For example, the aerosol formulation can comprise more than one propellant from the same class, such as two or more fluorocarbons; or more than one, more than two, more than three propellants from different classes, such as a fluorohydrocarbon and a hydrocarbon. Pharmaceutical compositions of the present disclosure can also be dispensed with a compressed gas, e.g., an inert gas such as carbon dioxide, nitrous oxide or nitrogen.

Aerosol formulations can also include other components, for example, ethanol, isopropanol, propylene glycol, as well as surfactants or other components such as oils and detergents. These components can serve to stabilize the formulation and/or lubricate valve components.

The aerosol formulation can be packaged under pressure and can be formulated as an aerosol using solutions, suspensions, emulsions, powders and semisolid preparations. For example, a solution aerosol formulation can comprise a solution of an agent of the disclosure such as a developmental disorder associated biomarkers' inhibitors in (substantially) pure propellant or as a mixture of propellant and solvent. The solvent can be used to dissolve the agent and/or retard the evaporation of the propellant. Solvents useful in the disclosure include, for example, water, ethanol and glycols. Any combination of suitable solvents can be use, optionally combined with preservatives, antioxidants, and/or other aerosol components.

An aerosol formulation can also be a dispersion or suspension. A suspension aerosol formulation can comprise a suspension of an agent or combination of agents of the instant disclosure, e.g., a developmental disorder associated biomarkers' inhibitors, and a dispersing agent. Dispersing agents useful in the disclosure include, for example, sorbitan trioleate, oleyl alcohol, oleic acid, lecithin and corn oil. A suspension aerosol formulation can also include lubricants, preservatives, antioxidant, and/or other aerosol components.

An aerosol formulation can similarly be formulated as an emulsion. An emulsion aerosol formulation can include, for example, an alcohol such as ethanol, a surfactant, water and a propellant, as well as an agent or combination of agents of the disclosure, e.g., a developmental disorder associated biomarkers' inhibitors. The surfactant used can be nonionic, anionic or cationic. One example of an emulsion aerosol formulation comprises, for example, ethanol, surfactant, water and propellant. Another example of an emulsion aerosol formulation comprises, for example, vegetable oil, glyceryl monostearate and propane.

The compounds of the disclosure can be formulated for administration as suppositories. A low melting wax, such as a mixture of triglycerides, fatty acid glycerides, Witepsol S55 (trademark of Dynamite Nobel Chemical, Germany), or cocoa butter is first melted and the active component is dispersed homogeneously, for example, by stirring. The molten homogeneous mixture is then poured into convenient sized molds, allowed to cool, and to solidify.

The compounds of the disclosure can be formulated for vaginal administration. Pessaries, tampons, creams, gels, pastes, foams or sprays containing in addition to the active ingredient such carriers as are known in the art to be appropriate.

It is envisioned additionally, that the compounds of the disclosure can be attached releasably to biocompatible polymers for use in sustained release formulations on, in or attached to inserts for topical, intraocular, periocular, or systemic administration. The controlled release from a biocompatible polymer can be utilized with a water soluble polymer to form an instillable formulation, as well. The controlled release from a biocompatible polymer, such as for example, PLGA microspheres or nanospheres, can be utilized in a formulation suitable for intra ocular implantation or injection for sustained release administration, as well any suitable biodegradable and biocompatible polymer can be used.

In one aspect of the disclosure, the subject's carrier status of any of the genetic variation risk variants described herein, or genetic variants identified via other analysis methods within the genes or regulatory loci that are identified by the CNVs described herein, can be used to help determine whether a particular treatment modality for a developmental disorder, such as any one of the above, or a combination thereof, should be administered. The present disclosure also relates to methods of monitoring progress or effectiveness of a treatment option for a developmental disorder. The treatment option can include any of the above mentioned treatment options commonly used. This can be done based on the outcome of determination of the presence of a particular genetic variation risk variant in the individual, or by monitoring expression of genes that are associated with the variants of the present disclosure. Expression levels and/or mRNA levels can thus be determined before and during treatment to monitor its effectiveness. Alternatively, or concomitantly, the status with respect to a genetic variation, and or genotype and/or haplotype status of at least one risk variant for a developmental disorder presented herein can determined before and during treatment to monitor its effectiveness. It can also be appreciated by those skilled in the art that aberrant expression levels of a gene impacted by a CNV or other mutations found as a consequence of targeted sequencing of the CNV-identified gene can be assayed or diagnostically tested for by measuring the protein expression level of said aberrantly expressed gene. In another embodiment, aberrant expression levels of a gene may result from a CNV impacting a DNA sequence (e.g., transcription factor binding site) that regulates a gene who's aberrant expression level is involved in or causes a developmental disorder, or other mutations found as a consequence of targeted sequencing of the CNV-identified gene regulatory sequence, can be assayed or diagnostically tested for by measuring the protein expression level of the gene involved in or causative of a developmental disorder. In some embodiments, a specific CNV mutation within a gene, or other specific mutations found upon targeted sequencing of a CNV-identified gene found to be involved in or causative of a developmental disorder, may cause an aberrant structural change in the expressed protein that results from said gene mutations and the altered protein structure(s) can be assayed via various methods know to those skilled in the art.

Alternatively, biological networks or metabolic pathways related to the genes within, or associated with, the genetic variations described herein can be monitored by determining mRNA and/or polypeptide levels. This can be done for example, by monitoring expression levels or polypeptides for several genes belonging to the network and/or pathway, in samples taken before and during treatment. Alternatively, metabolites belonging to the biological network or metabolic pathway can be determined before and during treatment. Effectiveness of the treatment is determined by comparing observed changes in expression levels/metabolite levels during treatment to corresponding data from healthy subjects.

In a further aspect, the genetic variations described herein, and/or those subsequently found (e.g., via other genetic analysis methods such as sequencing) via targeted analysis of those genes initially identified by the genetic variations described herein, can be used to increase power and effectiveness of clinical trials. Thus, individuals who are carriers of at least one at-risk genetic variation can be more likely to respond to a particular treatment modality for a developmental disorder. In some embodiments, individuals who carry at-risk variants for gene(s) in a pathway and/or metabolic network for which a particular treatment is targeting are more likely to be responders to the treatment. In another embodiment, individuals who carry at-risk variants for a gene, which expression and/or function is altered by the at-risk variant, are more likely to be responders to a treatment modality targeting that gene, its expression or its gene product. This application can improve the safety of clinical trials, but can also enhance the chance that a clinical trial can demonstrate statistically significant efficacy, which can be limited to a certain sub-group of the population. Thus, one possible outcome of such a trial is that carriers of certain genetic variants, are statistically significant and likely to show positive response to the therapeutic agent. Further, one or more of the genetic variations employed during clinical trials for a given therapeutic agent can be used in a companion diagnostic test that is administered to the patient prior to administration of the therapeutic agent to determine if the patient is likely to have favorable response to the therapeutic agent.

In a further aspect, the genetic variations described herein can be used for targeting the selection of pharmaceutical agents for specific individuals. The pharmaceutical agent can be any of the agents described in the above. Personalized selection of treatment modalities, lifestyle changes or combination of the two, can be realized by the utilization of the at-risk genetic variations or surrogate markers in linkage disequilibrium with the genetic variations. Thus, the knowledge of an individual's status for particular genetic variations can be useful for selection of treatment options, for example, for treatments that target genes or gene products affected by one or more of the genetic variations. Certain combinations of variants, including those described herein, but also combinations with other risk variants for a developmental disorder, can be suitable for one selection of treatment options, while other variant combinations can target other treatment options. Such combinations of variants can include one variant, two variants, three variants, or four or more variants, as needed to determine with clinically reliable accuracy the selection of treatment module.

Animal and Cell Models of Developmental Disorders

Also provided herein are engineered cells that can harbor one or more polymorphism described herein, for example, one or more genetic variations associated with a developmental disorder, for example, a SNP or CNV. Such cells can be useful for studying the effect of a polymorphism on physiological function, and for identifying and/or evaluating potential therapeutic agents such as anti-psychotics for the treatment of a developmental disorder.

Methods are known in the art for generating cells, for example, by homologous recombination between the endogenous gene and an exogenous DNA molecule introduced into a cell, for example, a cell of an animal. In some cases, cells can be used to generate transgenic animals using methods known in the art.

The cells are preferably mammalian cells in which an endogenous gene has been altered to include a genetic variation as described herein. Techniques such as targeted homologous recombination, can be used to insert the heterologous DNA as described in, e.g., Chappel, U.S. Pat. No. 5,272,071; WO 91/06667. In another embodiment induced pluripotent stem cells with specific disease-causing or disease-associated mutations (such as CNVs and SNVs) can be used for disease modeling and drug discovery, for example, as described in Grskovic et al. (2011) Nat. Rev. Drug. Discov. 10(12):915-29.

Autism Spectrum Disorder is not known to occur naturally in any species other than humans, although recently, an animal model has been developed that shows some features of the disease. This mouse model was created by replacing the normal mouse neuroligin-3 gene with a mutated neuroligin-3 gene associated with autism in humans (Südhof, M. D., et al., UT Southwestern; Tabuchi et al. (2007) Science 318(5847):71-6). By doing so, a gene was created in mice similar to the human autism disease gene. While the result amounted to a very small change in their genetic makeup, it mimics the same small change occurring in some patients with human autism. This and any other models described in the literature can be used with the methods of the disclosure.

Pharmaceutical compositions suitable for use in the present disclosure include compositions wherein the active ingredients are present in an effective amount, i.e., in an amount effective to achieve therapeutic and/or prophylactic benefit in a host with at least one a developmental disorder associated symptom. The actual amount effective for a particular application will depend on the condition or conditions being treated, the condition of the subject, the formulation, and the route of administration, as well as other factors known to those of skill in the art. Determination of an effective amount of a developmental disorder associated biomarkers' inhibitors is well within the capabilities of those skilled in the art, in light of the disclosure herein, and will be determined using routine optimization techniques.

The effective amount for use in humans can be determined from animal models. For example, a dose for humans can be formulated to achieve circulating, liver, topical and/or gastrointestinal concentrations that have been found to be effective in animals. One skilled in the art can determine the effective amount for human use, especially in light of the animal model experimental data described herein. Based on animal data, and other types of similar data, those skilled in the art can determine the effective amounts of compositions of the present disclosure appropriate for humans.

The effective amount when referring to an agent or combination of agents of the disclosure will generally mean the dose ranges, modes of administration, formulations, etc., that have been recommended or approved by any of the various regulatory or advisory organizations in the medical or pharmaceutical arts (e.g., FDA, AMA) or by the manufacturer or supplier.

Further, appropriate doses for a developmental disorder's associated biomarkers' inhibitors can be determined based on in vitro experimental results. For example, the in vitro potency of an agent in inhibiting a developmental disorder's associated biomarkers' components, provides information useful in the development of effective in vivo dosages to achieve similar biological effects. In some embodiments, administration of agents of the present disclosure can be intermittent, for example, administration once every two days, every three days, every five days, once a week, once or twice a month, and the like. In some embodiments, the amount, forms, and/or amounts of the different forms can be varied at different times of administration.

A person of skill in the art would be able to monitor in a subject the effect of administration of a particular agent. Other techniques would be apparent to one of skill in the art, wherein the active ingredients are present in an effective amount, for example, in an amount effective to achieve therapeutic and/or prophylactic benefit in a host with at least one developmental disorder associated symptom. The actual amount effective for a particular application will depend on the condition or conditions being treated, the condition of the subject, the formulation, and the route of administration, as well as other factors known to those of skill in the art. Determination of an effective amount of a developmental disorder's associated biomarkers' inhibitors is well within the capabilities of those skilled in the art, in light of the disclosure herein, and will be determined using routine optimization techniques.

Further, appropriate doses for a developmental disorder's associated biomarkers' inhibitors can be determined based on in vitro experimental results. For example, the in vitro potency of an agent in inhibiting a developmental disorder's associated biomarkers' components can provide information useful in the development of effective in vivo dosages to achieve similar biological effects.

Kits

Kits useful in the methods of the disclosure comprise components useful in any of the methods described herein, including for example, primers for nucleic acid amplification, hybridization probes for detecting genetic variation, or other marker detection, restriction enzymes, nucleic acid probes, optionally labeled with suitable labels, allele-specific oligonucleotides, antibodies that bind to an altered polypeptide encoded by a nucleic acid of the disclosure as described herein or to a wild type polypeptide encoded by a nucleic acid of the disclosure as described herein, means for amplification of genetic variations or fragments thereof, means for analyzing the nucleic acid sequence of nucleic acids comprising genetic variations as described herein, means for analyzing the amino acid sequence of a polypeptide encoded by a genetic variation, or a nucleic acid associated with a genetic variation, etc. The kits can for example, include necessary buffers, nucleic acid primers for amplifying nucleic acids, and reagents for allele-specific detection of the fragments amplified using such primers and necessary enzymes (e.g., DNA polymerase). Additionally, kits can provide reagents for assays to be used in combination with the methods of the present disclosure, for example, reagents for use with other screening assays for a developmental disorder.

In some embodiments, the disclosure pertains to a kit for assaying a sample from a subject to detect the presence of a genetic variation, wherein the kit comprises reagents necessary for selectively detecting at least one particular genetic variation in the genome of the individual. In another embodiment, the disclosure pertains to a kit for assaying a sample from a subject to detect the presence of at least particular allele of at least one polymorphism associated with a genetic variation in the genome of the subject. In some embodiments, the reagents comprise at least one contiguous oligonucleotide that hybridizes to a fragment of the genome of the individual comprising at least genetic variation. In another embodiment, the reagents comprise at least one pair of oligonucleotides that hybridize to opposite strands of a genomic segment obtained from a subject, wherein each oligonucleotide primer pair is designed to selectively amplify a fragment of the genome of the individual that includes at least one genetic variation, or a fragment of a genetic variation. Such oligonucleotides or nucleic acids can be designed using the methods described herein. In another embodiment, the kit comprises one or more labeled nucleic acids capable of allele-specific detection of one or more specific polymorphic markers or haplotypes with a genetic variation, and reagents for detection of the label. In some embodiments, a kit for detecting SNP markers can comprise a detection oligonucleotide probe, that hybridizes to a segment of template DNA containing a SNP polymorphisms to be detected, an enhancer oligonucleotide probe, detection probe, primer and/or an endonuclease, for example, as described by Kutyavin et al. (Nucleic Acid Res. 34:e128 (2006)).

In some embodiments, the DNA template is amplified by any means of the present disclosure, prior to assessment for the presence of specific genetic variations as described herein. Standard methods well known to the skilled person for performing these methods can be utilized, and are within scope of the disclosure. In one such embodiment, reagents for performing these methods can be included in the reagent kit.

In a further aspect of the present disclosure, a pharmaceutical pack (kit) is provided, the pack comprising a therapeutic agent and a set of instructions for administration of the therapeutic agent to humans screened for one or more variants of the present disclosure, as disclosed herein. The therapeutic agent can be a small molecule drug, an antibody, a peptide, an antisense or RNAi molecule, or other therapeutic molecules as described herein. In some embodiments, an individual identified as a carrier of at least one variant of the present disclosure is instructed to take a prescribed dose of the therapeutic agent. In one such embodiment, an individual identified as a carrier of at least one variant of the present disclosure is instructed to take a prescribed dose of the therapeutic agent. In another embodiment, an individual identified as a non-carrier of at least one variant of the present disclosure is instructed to take a prescribed dose of the therapeutic agent.

Also provided herein are articles of manufacture, comprising a probe that hybridizes with a region of human chromosome as described herein and can be used to detect a polymorphism described herein. For example, any of the probes for detecting polymorphisms described herein can be combined with packaging material to generate articles of manufacture or kits. The kit can include one or more other elements including: instructions for use; and other reagents such as a label or an agent useful for attaching a label to the probe. Instructions for use can include instructions for screening applications of the probe for making a diagnosis, prognosis, or theranosis to a developmental disorder in a method described herein. Other instructions can include instructions for attaching a label to the probe, instructions for performing in situ analysis with the probe, and/or instructions for obtaining a sample to be analyzed from a subject. In some cases, the kit can include a labeled probe that hybridizes to a region of human chromosome as described herein.

The kit can also include one or more additional reference or control probes that hybridize to the same chromosome or another chromosome or portion thereof that can have an abnormality associated with a particular endophenotype. A kit that includes additional probes can further include labels, e.g., one or more of the same or different labels for the probes. In other embodiments, the additional probe or probes provided with the kit can be a labeled probe or probes. When the kit further includes one or more additional probe or probes, the kit can further provide instructions for the use of the additional probe or probes. Kits for use in self-testing can also be provided. Such test kits can include devices and instructions that a subject can use to obtain a biological sample (e.g., buccal cells, blood) without the aid of a health care provider. For example, buccal cells can be obtained using a buccal swab or brush, or using mouthwash.

Kits as provided herein can also include a mailer (e.g., a postage paid envelope or mailing pack) that can be used to return the sample for analysis, e.g., to a laboratory. The kit can include one or more containers for the sample, or the sample can be in a standard blood collection vial. The kit can also include one or more of an informed consent form, a test requisition form, and instructions on how to use the kit in a method described herein. Methods for using such kits are also included herein. One or more of the forms (e.g., the test requisition form) and the container holding the sample can be coded, for example, with a bar code for identifying the subject who provided the sample.

In some embodiments, an in vitro screening test can comprise one or more devices, tools, and equipment configured to collect a genetic sample from an individual. In some embodiments of an in vitro screening test, tools to collect a genetic sample can include one or more of a swab, a scalpel, a syringe, a scraper, a container, and other devices and reagents designed to facilitate the collection, storage, and transport of a genetic sample. In some embodiments, an in vitro screening test can include reagents or solutions for collecting, stabilizing, storing, and processing a genetic sample.

Such reagents and solutions for nucleotide collecting, stabilizing, storing, and processing are well known by those of skill in the art and can be indicated by specific methods used by an in vitro screening test as described herein. In another embodiment, an in vitro screening test as disclosed herein, can comprise a microarray apparatus and reagents, a flow cell apparatus and reagents, a multiplex nucleotide sequencer and reagents, and additional hardware and software necessary to assay a genetic sample for certain genetic markers and to detect and visualize certain genetic markers.

The present disclosure further relates to kits for using antibodies in the methods described herein. This includes, but is not limited to, kits for detecting the presence of a variant protein in a test sample. One preferred embodiment comprises antibodies such as a labeled or labelable antibody and a compound or agent for detecting variant proteins in a biological sample, means for determining the amount or the presence and/or absence of variant protein in the sample, and means for comparing the amount of variant protein in the sample with a standard, as well as instructions for use of the kit. In certain embodiments, the kit further comprises a set of instructions for using the reagents comprising the kit.

Unless otherwise explained, all technical and scientific terms used herein have the same meaning as commonly understood by one of ordinary skill in the art to which this disclosure belongs. The following references contain embodiments of the methods and compositions that can be used herein: The Merck Manual of Diagnosis and Therapy, 18th Edition, published by Merck Research Laboratories, 2006 (ISBN 0-911910-18-2); Benjamin Lewin, Genes IX, published by Jones & Bartlett Publishing, 2007 (ISBN-13: 9780763740634); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8).

Standard procedures of the present disclosure are described, e.g., in Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); or Methods in Enzymology: Guide to Molecular Cloning Techniques Vol. 152, S. L. Berger and A. R. Kimmerl (eds.), Academic Press Inc., San Diego, USA (1987)). Current Protocols in Molecular Biology (CPMB) (Fred M. Ausubel, et al. ed., John Wiley and Sons, Inc.), Current Protocols in Protein Science (CPPS) (John E. Coligan, et. al., ed., John Wiley and Sons, Inc.), Current Protocols in Immunology (CPI) (John E. Coligan, et. al., ed. John Wiley and Sons, Inc.), Current Protocols in Cell Biology (CPCB) (Juan S. Bonifacino et. al. ed., John Wiley and Sons, Inc.), Culture of Animal Cells: A Manual of Basic Technique by R. Ian Freshney, Publisher: Wiley-Liss; 5th edition (2005), and Animal Cell Culture Methods (Methods in Cell Biology, Vol. 57, Jennie P. Mather and David Barnes editors, Academic Press, 1st edition, 1998), which are all incorporated by reference herein in their entireties.

It should be understood that the following examples should not be construed as being limiting to the particular methodology, protocols, and compositions, etc., described herein and, as such, can vary. The following terms used herein is for the purpose of describing particular embodiments only, and is not intended to limit the scope of the embodiments disclosed herein.

Disclosed herein are molecules, materials, compositions, and components that can be used for, can be used in conjunction with, can be used in preparation for, or are products of methods and compositions disclosed herein. It is understood that when combinations, subsets, interactions, groups, etc. of these materials are disclosed and while specific reference of each various individual and collective combinations and permutation of these molecules and compounds cannot be explicitly disclosed, each is specifically contemplated and described herein. For example, if a nucleotide or nucleic acid is disclosed and discussed and a number of modifications that can be made to a number of molecules including the nucleotide or nucleic acid are discussed, each and every combination and permutation of nucleotide or nucleic acid and the modifications that are possible are specifically contemplated unless specifically indicated to the contrary. This concept applies to all aspects of this application including, but not limited to, steps in methods of making and using the disclosed molecules and compositions. Thus, if there are a variety of additional steps that can be performed it is understood that each of these additional steps can be performed with any specific embodiment or combination of embodiments of the disclosed methods, and that each such combination is specifically contemplated and should be considered disclosed.

Those skilled in the art will recognize, or be able to ascertain using no more than routine experimentation, many equivalents to the specific embodiments of the method and compositions described herein. Such equivalents are intended to be encompassed by the following claims.

It is understood that the disclosed methods and compositions are not limited to the particular methodology, protocols, and reagents described as these can vary. It is also to be understood that the terminology used herein is for the purpose of describing particular embodiments only, and is not intended to limit the scope of the present disclosure which will be limited only by the appended claims.

Unless defined otherwise, all technical and scientific terms used herein have the meanings that would be commonly understood by one of skill in the art in the context of the present specification.

It must be noted that as used herein and in the appended claims, the singular forms "a," "an," and "the" include plural reference unless the context clearly dictates otherwise. Thus, for example, reference to "a nucleotide" includes a plurality of such nucleotides; reference to "the nucleotide" is a reference to one or more nucleotides and equivalents thereof known to those skilled in the art, and so forth.

The term "and/or" shall in the present context be understood to indicate that either or both of the items connected by it are involved. While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

EXAMPLES

Example 1—Method 1

One method used to generate the data herein is described herein. A study was performed of a comparison of copy number variants (CNVs) identified in 2 cohorts:
1. 1,005 Normal individuals (Normal Variation Engine—NVE);
2. 682 ASD cases (Data obtained from Sick Kids Hospital, Toronto, Canada);

Hybridization of genomic DNA samples from the ASD cohort had been performed. For the ASD samples, reference DNA samples were labeled with Cy3 and test subject cases with Cy5. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 3 µm resolution, using Agilent's DNA microarray scanner, generating tiff images for later analysis. All hybridizations were sex-matched; reference samples were pools of 50 male and 50 female samples, respectively. Genomic DNA for the reference pools was isolated from cell lines.

Genomic DNA samples from individuals within the Normal cohort ('test' subjects) were hybridized against a single, sex-matched reference individual as follows. Reference DNA samples were labeled with Cy5 and Test subject DNA samples were labeled with Cy3. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 2 μm resolution, using Agilent's DNA microarray scanner, generating tiff images for later analysis. All tiff images were analyzed using Agilent Feature Extraction (FE) software, with the following settings:

Human Genome Freeze: hg18:NCBI36:Mar2006, FE version: 10.7.3.1, Grid/design file: 021529 D F 20091001, and Protocol: CGH 107 Sep09.

This procedure generated a variety of output files, one of which is a text-tab delimited file, containing ~1,000,000 rows of data, each corresponding to a specific feature on the array. This *.txt file was used to perform CNV calling using DNAcopy, an open source software package implemented in R via BioConductor. Losses or gains were determined according to a threshold log 2ratio, which was set at −/+0.35. For example, all losses with a log 2ratio value <=−0.35 were counted, as were all gains with a log 2ratio >=+0.35. Note that, in order to maintain consistency with the other data, all log 2ratio values were determined according to Cy3/Cy5 (Test/Reference). A CNV list was thus generated for each individual in the 2 cohorts All CNV lists from the 1,005 controls (Normals) were merged into one master list, containing a non-redundant list of all CNVs found in the Normal cohort (NVE-master). The total number of CNVs (non-redundant) in the Normal cohort was 162,316. All CNVs from the 682 ASD cases were merged into one master list, containing a non-redundant list of all CNVs found in the ASD cohort (ASD-master). The total number of CNVs (non-redundant) in the ASD cohort was 72,183. After subtraction using the NVE-master list, there were 6,950 CNVs left in the ASD-unique set, a reduction of >90%. CNVs of interest (i.e., candidate CNVs causal of ASD) were obtained after annotation using custom designed scripts in order to attach relevant information regarding overlap with known genes, exons, and CNVs generated by a study from the Wellcome Trust Sanger Institute to each CNV region. Various classes of CNVs of interest were generated as follows:

1. Direct comparisons were made between NVE-master and ASD-master lists, in order to generate a list of CNVs present only in the ASD-master list (ASD-unique list). This list contains CNVs, which are a subset of the total set of 6,950 ASD-specific CNVs, that are: a) overlapping exons and present in 2 or more ASD cases and, and b) overlapping introns, affecting more than 4 consecutive probes, absent in CNVs defined by the Sanger study and present in a large number of ASD cases;

2. A probe-by-probe analysis for the complete data set was performed, in order to obtain lists of CNVs whose frequency between the two cohorts differed significantly (ASD-specific) list. Only CNVs affecting 2 or more probes and overlapping an exon were included);

3. For 17 unrelated ASD cases, data was available from both parents. A direct comparison was made between CNVs present in either parent and those present in their offspring, and a list generated of apparent 'de novo' CNVs (CNVs present in an offspring which could not have been inherited from either parent).

It can be appreciated by those skilled in the art that the number of ASD candidate genes/regions, irrespective of the class in which they are included, may increase or decrease when additional ASD cohorts are analyzed for CNV-specific genes/regions, or similarly if additional Normal cohorts are used to further refine ASD-specific CNVs.

Example 2—Method 2

A study was performed and comprised of a comparison of copy number variants (CNVs) identified in 2 cohorts:

1. 1,000 Normal individuals (Normal Variation Engine—NVE);

2. 676 ASD cases (Data obtained from Sick Kids Hospital, Toronto, Canada);

The Agilent 1M CGH array was used to detect novel rare CNVs in a total of 676 unrelated ASD cases. A vast majority of these samples had been previously run on other SNP microarrays. The ASD cases were competitively hybridized to a pool of fifty sex-matched Caucasian controls as a reference. For the ASD samples, reference DNA samples were labeled with Cy3 and test subject cases with Cy5. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 3 μm resolution, using Agilent's DNA microarray scanner, generating tiff images for later analysis. Genomic DNA for the reference pools was isolated from cell lines.

Genomic DNA samples from individuals within the Normal cohort ('test' subjects) were hybridized against a single, sex-matched reference individual as follows. Reference DNA samples were labeled with Cy5 and Test subject DNA samples were labeled with Cy3. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 2 μm resolution, using Agilent's DNA microarray scanner, generating tiff images for later analysis. All tiff images were analyzed using Agilent Feature Extraction (FE) software, with the following settings:

Human Genome Freeze: hg18:NCBI36:Mar2006, FE version: 10.7.3.1, Grid/design file: 021529 D F 20091001, and Protocol: CGH 107 Sep09.

The CNV calling was performed using Aberration Detection Module 2 (ADM2) algorithm of DNA Analytics 4.0.85 and a circular binary segmentation (CBS) algorithm implemented in the DNAcopy package. The CNVs detected by both algorithms were defined as stringent and were utilized for further analyses. For CNV calling using the circular binary segmentation (CBS) algorithm implemented in the DNAcopy package, losses were determined according to a threshold log 2ratio, which was set at −0.41. Gains were determined according to a threshold log 2ratio, which was set at 0.32. Any segment whose median log-ratio was less than or equal −0.41 to was classified as a loss and any segment whose median log-ratio was greater than or equal to 0.32 was classified as a gain. Any segment whose absolute (median log-ratio/mad) value was less than 2 was excluded.

ADM-2 analysis parameter settings were as follows: Aberration Algorithm: ADM-2 Threshold: 6.0, Centralization: OFF, Fuzzy Zero: OFF, Combine Replicates (Intra Array): ON, Combine Replicates (Inter Array): OFF, Genome: hg18, Aberration Filters: min Probes=2 AND min AvgAbsLogRatio=0.25 AND max Aberrations=10000 AND percentPenetrance=0, Feature Level Filters: gIsSaturated=true OR rIsSaturated=true OR gIsFeatNonUnifOL=true OR rIsFeatNonUnifOL=true, Array Level Filters: NONE, Expand Non Unique Probes: ON, Genomic Boundaries: Not Applied. After ADM-2 generation of CNV lists, all nested aberrations were removed, as were all CNVs <5 probes in size (using custom scripts).

The calls were compared with the CNV data from Illumina 1M single and duo, Affymetrix 500K, Affymetrix 6.0. and Illumina 2.5M arrays. For example, 304 samples in the dataset had previously been run on Illumina 1M single array that was analyzed using two algorithms-iPattern and QuantiSNP. The average number of stringent calls generated for Agilent 1M and Illumina 1M is 36 and 18, respectively. It was found that only 27.56% of the total Agilent 1M call set was detected using the Illumina 1M platform. Conversely, 45.64% of the Illumina 1M calls were not detected using the Agilent 1M platform. The difference in the CNVs detected using multiple platforms is mainly due to the differences in probe distribution and sensitivity of the detection algorithms used.

The ASD stringent CNVs (23,493 CNVs) were compared to the stringent CNVs from 1,000 PDx controls (49,524 CNVs) typed on the same platform as cases. Stringent CNVs were classified as “rare” in three steps:

1. A CNV was considered to be rare if it was found at a frequency <0.5% of the total sample set including 676 ASD cases and 1,000 PDx controls;
2. An additional 4,139 extant controls (SKS) were utilized to filter out common CNVs at ≥0.1% frequency. The additional controls consisted of 1,782 subjects from the Study on Addiction: Genetics and Environment (SAGE), 1,234 unrelated controls from an Ottawa Heart Institute (OHI) study, 1,123 European controls from a PopGen study. The SAGE controls were genotyped with Illumina Human 1M-single BeadChip arrays and OHI and PopGen controls were genotyped with Affymetrix Genome-Wide Human SNP 6.0 arrays;
3. From this list, for all CNVs such that the length overlaps ≥50% of the length of other common CNV regions including 5238 CNV regions that were genotyped previously (Conrad et al. 2010) and 1320 Copy Number Polymorphisms previously characterized (McCarroll et al. 2008), the classification made was that of a common CNV.

A total of 1,884 rare CNVs were thus identified. These were then overlapped with CNVs detected using SNP microarrays for the same samples. For CNVs not detected by the other microarrays (or if the overlap percentage between the CNVs detected using the two microarrays was <50%), the classification made was a novel CNV. A total of 946 novel and rare CNVs were thus identified. After removing intergenic CNVs from this list, the final total was 620 novel and rare CNVs (overlapping an exon or an intron of a gene).

From the list of 620 rare and novel CNVs affecting an intragenic region (exon or intron), a smaller list was generated, for which each genic region was present as a variant in 2 or more ASD cases. A small number of genes of particular interest, based on biological considerations, were added to the list. These genes were: YWHAE, CIB2 and GPHN.

Example 3—CD ROM Data

For each CNV listed in Table 1 and Table 5, the relevant intron(s)/exon(s) sequence for the CNV was obtained from the consensus HG18 sequence. The sequences in the text files on the CD ROM Appendix submitted herein are for complete introns/exons, rather than the specific component relevant to the CNV.

The sequence file 33655-708.202_PDx_SK_ST25.txt contains genomic sequence information for (in the following order):

A. All distinct CNVs listed in Table 1 (Example 1, method 1);

B. The full genomic extent of the transcripts listed in Table 4 (Example 1, method 1);

C. All distinct CNVs listed in Table 5 (Example 2, method 2);

D. The full genomic extent of the transcripts listed in Table 7 (Example 2, method 2);

For example, row 1 of Table 1 contains information related to a CNV whose coordinates are chr 17:77787243-77847938 and was discovered as a 60,695 bp loss in patient 1891. The sequence for this CNV is found in 33655-708.202_PDx_SK_ST25.txt and is referred to as SEQ ID 1 (sequence truncated for brevity):

```
Sequence entry starts:
<210> 1
<211> 60696
<212> DNA
<213> Homo sapiens
<400> 1
gtgctcttcg gctgtttcgt catcactggc ttctcctacg ccttccccaa ggccgtcagt     60
gtcttcttca aggagctcat acaggagttt gggatcggct acagcgacac agcctggatc    120

---------------------------------------------------------------
gctccctgca ctgctggttt cagtcatgtt gcaaggagag tattagcaac tcagtagtga  60660
tgaggtttag tggacatttt atttaacgtt ctgtca                            60696

Sequence entry ends.
```

For an example of a transcript sequence, consider row 1 of Table 4, which relates to the gene CSNK1D, transcript NM_001893. This transcript sequence is referred to as SEQ ID 644 and appears as such in 33655-708.202_PDx_SK_ST25.txt (sequence truncated for brevity):

```
Sequence entry starts:
<210> 644
<211> 31059
<212> DNA
<213> Homo sapiens
<400> 644
agggaagaaa ggtagaagtc attatgaatt tattatttac acgattgtta aagtacacaa     60
atacagtggc gatacaaacg cacagctcgg agactggccg tcagtgcaca gctgacacga    120

---------------------------------------------------------------
ctccccgccg cggatggact cggatcttcc gggcctaaat cccctttcag ctgcctaaag  31020
gagccgccgc catcgcgctg tgacgtcact tcccctagc                         31059

Sequence entry ends.
```

The same system applies to Tables 5 and 7.

The sequence information contained in the CD ROM Appendix can be used to identify a genetic variant associated with a Pervasive Developmental Disorder (PDD). This identification can be done by PCR, FISH, sequencing, array hybridization, or similar genetic analytical techniques. The sequence information contained in the CD ROM Appendix can also be used to design PCR, FISH, sequencing or array reagents for the identification of a genetic variant associated with a Pervasive Developmental Disorder (PDD).

SEQUENCE LISTING (2739 sequences)

SEQ ID NO: 1 - DNA, 60696 bp, Homo sapiens
gtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcccgggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagtatgtggttttgctgtgtggcctgtgtcctgactcgcacgtctgctgatggcctggctgttcctaccgtggctctgtcctcgccagctttccctgcagcggcatagcattcgtagcaggggcaggcgctgcatggagggggctgcggggcaggtgcctggaggccgctgtgccagggtggcctctgaaatgtgccagggagcccctacgtggtggttagatgggagctgaggtggaacaagccactttattcactgctgtgtttaagaaacaggaccctcctgccttccctttttcgcccctctgcctggctggcagtgtgcgtggtgtggtcagtgcccagggctggtctttgcaccctgtcctccatccagcccggcccagcgcttgggcttgtcctggacacctaacacccacctgccctcgtggccagcagtggcctgcgtggctgggagcccggtcagaggccgccggggccctcagtaggtgcgtcgtgggcgctggggacggcagcgggtgccctggcgggccgcgtgcagccggagagatgccatgtccctgctcctctgcaatgaaaagcaagcgaaaagtgcacatctcaggtccagctgtccccatctgcccctggccttgcgccagctgggcttgagctcttgcagcccaggctcctgcctgcagcctcagggctgtggaggcctctagcagggctcaggctggcgggcagtgccagcagttgcagggatcaaggtcagactctgcacagctaggcccatgtgtctcggcagagtccaccagtcccacccagcagctgaagggagaaagacgaggaggcagggagcagacgaggaggtggggagcaggcagcccgggcctcagaggacacatggccttcccccgctggcacccccacatcagggccaccaggggactgctcacacccaggggttgccgcctctggacctggctgtccctggttctgctgacctcaggagtgacctgggcttacagaggtactggcagggaggtcatgggccgggtgaggggtgctcgctcctggaaccctgtttccaggtatctcgggccctcaccctcccctaggcaggaagcagtctctctagctcaactgtcacccctcgtctgccccactctggtccccacacccacagcacacagcagaggctcaacacaaagtagccaggcagtgctgctcccggacagacatgcctgagggaccgtgctcagtgattcaggagtggtccagatgtgggaaggcagccacgcttggttgggggcacaggacgtgtgggggctggggtccctgtgccgcagggtgggcgtgagtgggcgctgagttctactacctcctccctcagctggtgcctttaaaggagggaagccatggggcagtgggtctgctctgacccgacaggcaggagtgaaggggaagggaagggaagcccggagcccactgggaagaagctgggggcagaggtctggtgcgtgggctgcagagctatcccccaaccccggcgacagattctagtgccaaaagtggttcaggtctaccgtgttgtgaagatcccctgaccagagacacgtccgtccagaacccactgctacttggggtgggggtggggggcagagggcgcacagacttcttcacatgatcccagatcagagggagaagggaggtgtccgcccggcctgggccttcccagagaacagccctggaacagatgtgtgcaaggcctgtgccgggggaggtggcgggggaggcacaggggacccagaaagggcttggtggccccggacgctgccgtccctcagccttccgaggggtctatggtgaagctcccgggaggcgctgcccagtacctggagggcctgctcttttcagcgtctaaaccatgcctgaggacacagacccagccagactcaggttcagagaacaagccctctaactctgtccgctcatgcccccgcagatgagatggaacaggccttgaggacatgcagcccctgctccctctcagggcagggaaccccaggagggcagctgcaggcctgggaagctcaggcaggaactggaacttgggtcttgccgttttccggttggggccggtgagcggggcaggggctgagcctcacccacggccacagtgaggccccacacggtgtctcagtctggggcagcaagagggaaccacgtgaggcgggctggagacagggaaggcccggaagccagctcagatgcccagggcacagccagaatggctgagaggaagggcctgggaggaggcaaagtctgggcaggaggggctggcagagctccaggccatgggcatccccacggttggggaaggagtgcatcacaggcagagttggcgggacagccccggaacgtggggctcagaaagctacaccgttcttagagcaacctccaggcaagtgacccgaagtccctgtgctttttcactacaaacaaaaatatcctcctcttaggcagcgtgaccctggccaaggggccaagggagtggcctggagtggagagtactgggtggaggtgggggtgggaggggagctgggaggggaggcggcctagcctggctgagctcacccacacacgagcacaggttaggagttggtgcagacctccctgctctggcagcctgacagcccccgcaggccttggataggggccactgctgtgtgctctggggggggggggaagaggaaccctatctccttgtgcctgtgcagggccatcgggcagctcctgggcttcaacagctcaagcgacagggggatccctgagcaccacggccctatggcagggggaagggacatgcgctcaccccaggcggctggagtgcggctgccggtgccgcccgagaaggcagggactctccagaaccgtcacacagaaagtgcgtggacttctgtgtgcacaacagagcccaagggggcagcacggcgaggagcagtcgccacccctccctgcccggcagcaggcccagggggcagctctcctgctctgccagctcccagacacccacaggctgagaaagaacaaacagccatctcaaagaagtattttcacacagttcacctcaacacagtgaaaactctcaagctgatgaaataaagaccacatggaaaggggagggaagaaaggtagaagtcattatgaatttattatttacacgattgttaaagtacacaaatacagtggcgatacaaacgcacagctcggagactggccgtcagtgcacagctgacacgacgtcctacctacgtctcctgcacggggcgacggggactagatactgggcaaggactgtcacaagcactccgaagacgcgacccggcgaggctcgggctggaacccgggcgcagagctgcctcgcacaaacgttctgggcactacatcgggaccacagatatttacaaagcaagcttgcgccacttcaggccacagcgcgacgtctctccgggtgggggacgtctaccttcaagaaggggtccagcaacaaagaaaatctcttaactcggctctgacccaccccaacctccctctgtacttcaacacacagctcccacccgctcaaggccccgtactccaaaacgcttacacagtaaccagcctaggattgagaaagcatccatgggctcaggcagacggccagccagctggtgggggggtgaacaactgtgttctgggacgccagccagttatggcatccggggaactctggggaggagaagggagaaccaaggtgcacaccttcgaagccctagagtccaaagggaacatcgtccatcgtgatggggtccagccgaagtgcccacgaacacagactgccctgcgcattggggttgggagcacatggccactggctaccgcccaagtgctgcggagtgagaggcgagaaggcatcctgggaacctcagggcacagcagcatggagcctggggcagcaccagctcacggaggccacctgccttctggtgggactcggccccacgcacgctgcttcacttctgaccaacagacacgcgcccaacagaaggtcacagcgcagactctactttctggccgtgaaggttctgggtccggttgggagagtcacctgctccttggcacctcagggtgggtccttctggcctgccggcttttctgagctagtcttggcacgtggcaaggacagccccgctcctggttttaagcacaggcattcatacagacggagtgccaatccgcacaggagcattgagtgctgagaaaatggactgagtgcaaaggcagcaaggcaacaaacactacagtaaccacctctcggttcacagtcctctcccaagggaccagaaacgcatcttccaccttgaatcctgggactcccaattgtcctgctagggtctcaaagcctctgcttccaagctctcagctgcctgcccacctcctggggaagaagcgcgcagtgctttgcctggtaacacccactgcacccctgccccgcggcagcctgcggtccctaactgctctccgagggcctcaagagttcctgacagcaggcatgtcaattacgggaggagggagggtgagacgccaaaatcaggttgaagaggtcccaccacacacgggcacacacacacaccacggacttttgatgagaaatctcctctccaaagcggacaataaaacactgcaaaacaaacacagcacacacccttgagatccacctgcaccttctccctgcccgactccacctcatacactaactccaagccagcctgtctcagaattccttagtcaacattttttttgtaagactgcaaaaacagacaagaaacaataaaaagacagattttctttacacagatttaagccaataatttttagcaaaatgatacaaaactgtcttaaccaagtagaagattggtagttacagtggaatcgtcagggagtacagggcggccaccactggagggagctgaggccctggaaaaggagtctgattctctgcaattctctctctgcttttcttcccagccccgttacaaccgagttcacgtggggggccgcagtgcagccccagcggtggcagctcttggagtctgtccgtttagtatgtttcccccacgagcgtcgctgggtgagtggcctggagagctcccggtgttaacatttcgatcctagaccgggggacgtgtcactagtaaagccattggtaacagagtagatcagccatgcattgtctgcccttcacagcaataaggagagttctcatcggtgcacgacagactgaagaccactggaagccacccgaccaggaatctgtcggagccaaagcacaggagaaggtcagcatggggctgggggagccggccaggcagataccacagtgacggtgctgggcagggaggggacgcaccgccaccgcctagccccagtctagacgcctgcgtcccccgccacgcacaggggcctctgtggctgggacacgtgctcagcagaacgagtgacaggaagacgggaaggaggaagaggcatgcaagcaaggtgcccgcggagccgggctcggcagggtcgaaggatccgagtggagcggagacgggtgctcctgcctcccttcctggaaaggaacctggtgtttgaaaatgggtacccctctcagggaagacatgaaaagcagttcctgtcaacacatttccagagtgtgcacagtgtgaaaactgcagcgggtctcccagcggcacagacccgacagaagcgcaagcccctgctggaaggagccgccgagcgcgcgtggccgccgaggagggagcacagcgtggacgccggccatgcaccgacggcggggagtgagtgggctgcggctggaggagttaatacagacgaagctgcgtggacaagacggctgggcagagaccaagtgtgaaaagaaacacaaaacaaggacagagataaatgagacaggaagagagaggcgactagaaaagctggcatggcagagactgcccagagtgtggcgcagcaagagcttaggagcccccaacaccaagcgtggagccacccagctgagcaggacacagacgcccctccaggcacggccgaccgcagacaaggcaactcaagtgctcggggcacccgccttgccactcctgcctcacgggtgggcacccaggacaggaggagagcaacggcacacggaacgcagtcacggggaggccacaggccaacaggatggtctcctggggtcactctgttccaaagctctctgtggacagcctccccccaagactgggcagcggactgccgccgctctgcaccccacaagaagaacagagcagaagaagcctcactctacctccagcacctggcatgcaagcccagcccacctgcaagctcccatgggtggggcatggtggctcccacccacctggcgctgctgcctggcgcccgccacgcgcacactcacccagtgctgccttccgatgggagacgagcagctacttgccgtggtgttcgaaaggaatgctattctgaggtggggaaaagacagctgttggtaagcgtcccgctggccccctgactacctgtgtcggctccatgtccagatgggcatccttgcctcaaccaggtccacagaccgacaggtgccacctgggggagcccaggcacagagcacagcctcacttgcctctcaggacgggcctctggatgagagtggtgcccactcctcttctggaatcacttgctcttaaggccaacaatggcatgggacaggccctcctgagtcttctcaagcactaagaaaacctgatcccagcaggatggcaggtgctgggcagccccacaactgggtctcagggcacagcctgaaggcaggggagacgcacatcctcgccggtacgacgacagggctcaggcctagtcctgggcaggagttgatcaaagcgagtcatcgactgttggaatgacaaggccttcttctcaccaagtaaaaaccccaaacagactcagcaactagatggcctttagggcccaggctactgtagccaaagagccctggccgaacaccaacagcccgaaaagagagggggcgaagagggaacagacccaggcggagtccgggctggggcggggccctacaactatgggggcctctgtgacctacaggcaggctgccacgtggtcttccacccatccacacccagccacggccagcaagccctgggagaccttcctgctgcctcctcccatctccacagggcgcaaggtctcctgagaggagcagaaagaacagggaagagcgacggcccgaggaggaagactggccggggatgagtcactgcccacggtgactgtgtctccagctcacccgagcaaacaggtgaggcgctcagagcaattgagcctcctgtattcccccttgggattcaaaacgggagctgctgctcacagccaccacgtgtgctggtgctggcagagtctggcaggaaggacacacggccaaagccttcctgtgagatggtgacaaaggagggggcccgccctggaggtggggagccctcaacatgcctctcaggaaggccccccagggtgtccaggagcagaggccaagaggcttcttttggagagaacacacccccaaaccagctctctctggagactcctccctgctgttagagcccacgttgtatttcctcatatggaaaacgagggcctaagagccagctgcgggttcctgccacagctcaccatggaaggagacactgctcacggccaccttgggggctggtggctacaacagccacacccaggtgccgccaaggccgtgtaccgagaaaaggcagctggactcagggctgtggctactcagcacgctcaggacaccttcactgcccacaaagatcccaaaccactggacactttactttctttaaaagaaacaaaaagcactcaggccccttccctagtctttgtcagccaagcgctggggcgaggctgtccaagtccggtcagcacccagcatggggagcactctgggctcctgtaccatggttcaggggctacagagccagccgcacatcaagacacgagggcacgggcagaccctcccgggaactgctcacaggaactgatgcgcaagtgccaggctcgtggaaagaagccagttaaaccctttctgtgctgtgtctggaggtgacagcagggttgtgtgcacgtaagggacccattctcgtgacgcagcccagacccctcgagcccaattcatataaccacaaagtcaaaataaccacgaagccaaaatccctgcatctttggtctctttgggaagaagttatacaaaaaggtctgtttctagtgaaattattagtgaattagaaacgtgcagtaaaaccccaatcattaaaagacggcaagtggtcaagagtgctccccactccggcatgttcctggctagccagctacacccagccccgctcacggcagcaggcctggctccatcctgtgatcccaacaaacacctccccacaagcccagagccaggctccagggcatttctgaactgagttcctgctcatccggaagacccgtgggggatctgggcaccccccaggatgcctgctggtgaaacagccctgccccactaaccctgcccctgttggcgaacaacccagaaaactatttgaagaaatataatggatccatatggagaaagctgttctagttcaaagagcacgttagcaaacgcaaaagacaacaaaagccagagcgaggagaggagagaccgctgcaggatgctgaagaggcggtggccgtggctaggcctgggctgcgcaacagggtacttctcgtccaagggaagacaggtgaggccgtcaaaagaaggaaagcctcgttgcagggcatgccaccagggagggtctcacaagaagcccgtggaggtccctacgggcctccatccctggccagtggcaagaatgaggaagaatgaggaaggctccctcgggctgggggcacccacaatggggcgcaagcaggcgagcggtgtcagctgcctggggacggctgcgggcagcggggcactcaaacagcaggagaaagcccccacggtttgctggcctcagggacctgagacctgagactggccacctgcaaccaggagacaagccccatgacggcccagcatgtctcccaggccctcccgagaagcctcatctgcaaccaagacgccacaccctggcgagattaaaaactctcaaaaatggggggaagaaaggaaagaagaagccctggagaaaccacagcccgctcttgactcggacggggtagcccgaggcccagcgcccgcccgggagctctgcacctacctgtgaggtggacatgcgagaggtatcttgtcggcctgtgaggtcggacgaggagatgttgacgggggccccgcggtgcagccgcatactcactttccgctctctctccatgccggagacgggccggggggaggtgttagctgaggacagggagagaaacggagtgggccgcccccgtctgctgcctctcactcggggctttctatgagaggctgtggccagagaggaccctgggctgcctggacagtcaggacctggctgtggccgatggccaccaacactcagatccggccggagggacacaaagggacatgggagcgaggtcaaggggctcacaggggaggaacgtgagatgcgggaggaatcacgcacaccagcaggtgccggcatttctaaaggcgcctgggcagcctggctcatccaccctcaggagcgagcatcgcctgacacagggcacttagtgtccaccaccaagtaccctgttgtccccaccaaccccaagacacaagaagtcaccccagagccagccccagagcgctgggaggggggcactcacccgtgtgtgaggtaggggtgaggggtgtggggggagccacttcctgcgtcccccgcaggcggccggaggctgtggaagggaggccgcgggtagccgggttccgcgagtgtctcagccgctcctctcggtccctgcgctcccgctcggcgtcatcggcggcccggctggcaccctgaggaggcaggaggtgaggccggaatggaaccagctttggcagaaagcaaccctaggtcctaggctgccccggccacgtgagaaaatacctaccaaagggcactgggacgagactgcctgcaaagccccccacaggctgcacgtttctcctcatgggatgacagcatcatccccacaaggggtcagagccaggcctctcagctcccccaacaatcgaaaaaaccccactcgccatggcatctccctgtgggctcagaacttccttaaacttccaaatgggcagcagctaccccctgctgctctgtgaacatgctcactaacacgtgcagaaagaggagagggacaggaaccatcggaggccaaagacaggccccaaatggtgacagctggggaggaaagcggggtggggatgagagcgtttggtcggacgaggagtacactcagggtccggaccctgcagcctccaacagcctgtgcaggtgtggtggcgtggccagcagccggcagccggatctgtgctgcactatccagatgcacgggggtggggaggtcagattttaagccgagacagcaacctatgaaaaagcagattctaactgccaatgctgtgcggcaggggcctgcaaactacagccccggggccaaacccaggtgccacttcttcctgcaagtacagctcattggacacagccacgttcaccaggcaacacacagaccgacacacctgcggctgcagcaccgtgcggccagcaccgcccagactcctcatgctgccatttacggaaaacgctggcctagcctgctctgagggccgggtgactctaatgccgcaggagggtcgctctgattcctcccgaggcagcacagccccggcagagggactgatctgccctgccgagtgcacccctcccggcacctgggccccgaggctcgggcctgcctcgcctgccatctctccggggcctccaagtactccccacgctgatgggcacttggcaagtaagtcaagatgaacagagtgcacccctcccagcatctggagaccccgcccctccctggcccctgcacgactactggacaaggctgccgtttttgtaccctcccaagaggcagttctgctcctccatcagactgctgcctggaaaagctccaaattctatttaaaactgacaacaaaacagtaagtttttaatgaaggaacacaacagttccacaggagcttcatttctgacagcggtgtctgaaaagtaattcagctcagacatggacccagggctgggctgcctgttttagaggctccactgcatactcacaccgcatcaagaaagccacagggaaaatcagctcatgacagggtcagtcaggctagacgggtagcacctcaccaggccccaaccccactcatctcgtgggcaccacgaccatgtggcacagcgaatgggaatgcgcacccccagcccccaccctctgcccccagggcatgctctgggccctagctccgcttggtgacagggagggaaggggcctcctgctgtccacacccaggaattccatggacccctctgcgttccctaatggcgtcttacttcttggcacccctttctggcaggcagacacccactcagtccaggtcctgcccactacacacttgcccttcacaaccagagacactccctatatggtacagcccctcaacaagacggccgccggcctctcactgacaagccatcccccgcacaccacactcagcgaacgtgctggcagtgcgacttacaaatttgagcatgttccagtcgaacacgtagtcataggagaagccctggcgatggaacagattccggaaaagctgccgcaggtacgagtagtcaggcttgtcgtcaaaacgcaaggaacggcagaaattcaggtatgtggcaaattcggctacaaaacaagaaactcaaagctaactcatgaaacccaactgcgactcaaggtgtctctgccaacgtcgctgtctacctcctgctgctgcacactcaaggggagaaggacagatgcaaaacacctgtcagatttctaagacctgaagccttgagaaagcatcgaaaagtattcaagtcacggccgggtgcggcggctcacgcctgtcaccccagcactctaggaggctgaggagggcggatcacgaggtcaggagatcaagaccatcctggctaacacagtgaaaccccatctctactgaaaaaaaaaaaaaaaaagttctagagcgtggtggcgggcgcctgtagtcccagctaccggggaggctgacgcaggagaatggtatgaacccgggaggcggagcttgcagtgagccgagatcacgccactgcactctagccttggcgacagagtgagactgtgtcttaaaaaaaaaaaagaagtcataaagcacaatttagtttcatttgaggtgtgtatcctggggcaatcctacaaatgcaaaggaaatctcccgagctcctggagggggccagagagggcagccactgcagagagaggccccaccactgcctgtccatccctttccagccacttggggccctgaggctcgggcctgccttgcctgccatctctccagggcctccaagtactccccacgctgatgggcacttggcaagtaagtcaagatgaacaggagggcaggctgttacctccatacacaaaagcgccccgctttcctgccaccacccctttggaaggtgagcaactcttctgacaaaacccagactgagccgtctcggcacacccgacacatatgcaacccctgtgagcagctccgctgagaagaggcctccagagacttacaagggtagcctttacacaacacttcgatgggggtggacattttcttctcgctaatcctttcgtatttctgtctcttggtggcagccttcagcccctgccaggggagagagcccaggttgaagtacattagcacgtagcccagagactccaagtcatctcttcgggattgttctgaaaagaaaagggaaaggcgtgaagaacggcacttgcgtgctcacgtcaaagcaaaagacccggctggccgttccagtggagactagcctcagacacacatgcccagatcactccagctggcacttccagtggagacgaacctcggacacacatgcccagatcactctcacccagagctgcccctcatgcatactaaggaaattcccaaacacatcacaggtgactcagaaatgtcccagcatccgcctgcccccatacacctggcagtcacgagccagcctgtctgccgcaaaggtctgatgacacgcttgcagccccagctccccgagaggctggcctctccctgggctgaggcatggacgcgcccaaaggcaccccaggtcagtgaccccatgcccaggggctcaccaattccaaggtgcgtgttgatggaggcgtaccgcgccgtccccgtgaggttcttgttctcacgataggggatgtgctggtgggtgcgtgcatcccggtacttcttggccagcccgaagtcgatgatgtacaccaggttgcccttcttccccaggcccatgaggaagttgtctggcttcacatcccggtggatgaagttctttgaatgaatgtattcgatgcgactgatctgtgagcagagcaagggcgcgagatggcaccccagggcagtctcagggagggaccgctcaactgtgggacactacatcagtggctgcattgttcctgcccctcagccacagcagggtagtttaacaattagcgagggggatgccgaactgaccaaattgttcccccaggtgcctgcagcaaccctccacactccaccctccacaggcctaggcgctttgccttcagctcccacaaaacagagaggtgaggcgacagagaggggacaacccgccactagacatcggtctctcccagcactgttctctgcacagactacacaccaggattagcagagaaactgcacggaggtgcttaggaatcacgtgtgttcctgagagactgaggaacccactgaatggaaacgtgctatgctggtaccgagaaggtggcctccaagccagtgagctgagccaccagagcctcgagaagccagtgagctgagccaccgaagcctccagaagcctcgagaagccagtgaactgagccgccggagcctcgagaagccagtgagctgagccgccggagcctcgagaagccagtgagctgagccgccggagcctcgagaagccagtcagctgagccgccggagcctcgtgaagccagtgagctgagccgccggagcctcgagaagccagtgagctgagccgccggagcctcgagaagccagtgagctgagccgccggagcctccagaagccagtgagctgagccgccggagcctcgagaagccagtcagctgagccgccggagcctcgagaagccagtcagctgagccgccggagcctcgtgaagccagtgagctgagccgccggagcctcgagacgccagtgagctgagccgtcggagcctcgagaagccagtgagctgagccgccggagcctcgagaagccagtgagctgagccgccggagccttgtgaagccagtgagctgagccgccggagcctcgagaagccagtgcagtgcgctgagccgccggagcctcgagaagccagtgcagtgcgctgagccgccggagcctcgagaagccagtcagctgagccgccggggcctcgagaagccagtgcgctgagccgccggggcctcgagaagccagtcagctgagccgccggggcctcgagaagccagtcagctgagccgccggagcctcgagaagccagtcagctgagccgccggagcctggagaagccagtgcgctgagccgccggagcctcgagaagccagtgagctgagccgccggagcctccagaagccagtcagctgagccgccggagcctcgagacgccagtgagctgagccgccggagcctcgagaagccagtgagctgagccgccggagcctcgagaagccagtgagctgagccgccggagcctccagaagccagtcagctgagccgccggagcctcgagacgccagtgagctgagccgccggagcctcgagaagccagtgagctgagccgccggagcctcgagaagccagtgcggtgagccaccggagcctcgagaagccagtcagctgagccgccggggcctcgagaagccagtcagctgagccgccggggcctcgagaagccagtgtgctgagccgccgggggcctcgagaagccagtcagctgagccgccggggcctccagaagccagtgagctgagccatcggagcctcgacaagccagtgagctgagccgccggagcctccagaagccagtcagctgagccgccggagcctcgagaagccagtgagctgagccgtcggagcctcgagaagccagtgagctgagccgccggagcctcgagaagccagtgagctgggccgccggagcctcgagaagccagtgagctgagccgtcggagcctccagaagccagtgagctgggccgccggagcctcgagaagccagtgagctgggccgccggagcctcgagaagccagtgagctgggccgccggagcctcgagaagccagtgagcggagccaccggagcctcgagaagccagtgagctgagccactgcagcctcaaggctgaggctcagcaaatttccatttcctctgtgaattaatggccataataatggcaagaacagcacaagcgagtggctgattctatcagacagcaagtgtgtgccaactgtcaggaaacagtccttaccatttggtcagcaagcagcaggacggttttgaggctgaatttcctggagcagaagttgaagaggtcctccaggcttggccccagcagctccatcaccatgacgttgtagtccccctctgccccgcaccatctgatggtggggatgcccactaggcaaggaaatcagacacagtgtttcagtccaggccctgcctcagctccacactaagtctgcactgtgcacaccaaggggtcatggtgacaatcctgaacgggggaggggtggtggaggtagaagaccccggcaacgccgctcctcagggacccatcctcgagattaggccccatctattagcaaatggcctgaggcagacgttggatgagggccaagcagacaggagctgtaagggggacaaggaggggatcgaagccccacctccccgactcccgtcttctagggcaggggggcaggagacacagaaagcagccacgatgtgggaaagaaaagagctcaggcataaaggagcagcagagcccgccagaaacgtcacacaggagatgggaggagagaaagcagctaccgtgggttaggtgagagaagaaaatatgttcaattactccgatgttggtagaagtatttgactggataagagaaaagcaaaagcaatgaaaactttttggggatttacacagtaacccaggattgaaatatacaaatcagggaagtgaaaataaagacacaataaatccaacaggaagaatttaaagatggctgcatagtatcagtgctgaaggcataatcaacactataaaggcacacgggccaggtgcagtggctcatgcctgtaatcctagcactttgggaggctgaaacgggaggactgcttgagctcagaagttcgagaccagcctggataacaaagggagacccttgtctctacaaaaaattctggaaattaggtgggtgtggtggcacgcttctgtggtcccagctacttgggaggctgaggcaagaggatcacttgagcccaggaaatggaggctgcagtgagccgtgatggcaccactgtgctccagcctgggccacagagcaagaccctgtcaaaaaaaaaaaaaaaaatccattttagaaaaaatgggtgaaagacctggacacttcacccaagacgttacgtatgaaaagtcaacgaccacaagaagattctcagagagatggaaaacacatgctggtaaaaacatgcacaggaatgtgcaccgcagcctcacgccacagtcaaattcaaatgctgcagcaacaggtgggtttctcaaaatgccacccccaaaatacgtcctttggtcctatttttttttctcatatccacaagaacatgtctcttcggtatgttttcacagcactggatccgcaactatacacatggctctacacacatacggcttgtgaacggcctggataaaccttttatgtccttccatggcaagacagatttttagtttagtcttaaagcaagttttggtaccactagggaaattcaattcatttaaaaaattgtttcattattttattgttttgagacgaggtctcgctgtcacccaggctggagtgcagtggcaccatctcggctcacggcaacctccgcctcctggattcaagcaattctcctgcctcagcctcctgagtaggtaggactacaggtgggcgccaccatgcccagctcattttactggccacatgtatcgcctctcctctgaaggcatgtatttttttttttggctaagtttttctatcatggtatctttttcctattcatagtagttctttataacttctagatactaaaccactgcaggttttttgtgaggcaagtatctctcagttaatggcatgttttttattttcttctggagtttcttgatgaaaagacttttcatgaatatgaatgccttaatcttttgctttatgagtgctttcagtatcttacattaaaaaaatagtttctgccctcagcgtcaaaaagagatgctattgtttttttttaaagtgttaaagttacttctacttctaacaaaaacagtaataggggcctgattcgccctcacaccttaagtaactaagggaaagaacaaaacacacaccctcacacatcacagggtggtttccacaacactgggcccggccaatgactgacagccgtgccagccagtgacagctgtgcctgagggcgggaaggagccgtgagagggcgccctgggctgccccctgcactgctgggagcataagcacaaacgccagactgaacagatccatggaacccaacctcatcccagaagagagctgaggaggagcctgcagaatgtggaagagcacagcatgcgtgacattctcaatgtccggcatccaaagtggaaaacaaacctggagtaagaggttaactgaacagacccggatgttcacatcagcagggaaagccatgaaacgttactacagatttcgactgtattccaccgtcgaaaagttttttaactggccaggctcaggcctataattccagcacgttggaggtggaagtgggaggatcacttaagtccaagtttgagaccagaaagaaaacatactgagacccccgtctctacaaaaaaattttaaaaattagctaggcatggtgctgtgtgtctacagtcccagctactcgggaggctaaggtgggaggatggcttaggcccaggaagtcgagactgcagtgagccgtgattgcaccactgcactccagcctgggtgacagaatgagaccgtctcaaaaaaaaaaaaaaaaaaagttaaaggcatgaggcatatacatatatatgtgtatttatgtttcggtcttttatatatatgtatatatttatataaaaaacataaatgtatatataaacctgaacatatgtgtatatatatatattatatatatgcaaatacacatctactttcagatttgggaatagttgcattctgcgtcacagtcgagcatccctaatctgaaaatccaaactgcccccattagcatctcctttgagcatcatgttagcactcataaagttcccgactttgggtgtttcagatactcaaccttattacggatttgtgaattcttttctctctctagatgcagcattacggattcccaaattccctttctccactccaatgagtcacagttccttcttcttaatactcattttggagttttcactgtcccaaatttaggcaacagatcacctttcaaactttttcccgtacctcataacaaatgcctgccatgtgttccagattcaccttctttctttctgccccagccctggaatcagctgcttctccaagcactcaggactcctcttaacagagaatgataaatacttagaaacccctgaggcccggtgtgctcagtgttctaggctgtcctccttctaagcccttctcgtggccagaaccacacaaagtatcatcacgacagctttatagtaagtgctggtgtttgcagggcaaatggccctcttcttcacaagtgttttaattaatcctggacttgcactcttctcagtgaattctagtcaccttgtcaggaaagagaagtggctggatgtcgatgggaacgtcattgaatgttaagagcaactttgggagacctgacacctggcatcttcctttctctgaacatagaggagaattaagcaaatcttccttaaatgtccttcaataaagtttatatattttctgcatgcagatcttatctgtcttaaaatttaccccagatacctttttgctactgtaagcattatgttttaaattacattttgtaaccaattaaattgttggtttaacaaaatgaattgattttatattttgatcttaaatttgctcaactctctaatctgttctgagatccctatttaggaaattacatcacatcacatgccagtaacagcagttttatttctgcctttttcaccctctgccctgctgaaaacagtgttgtgaggctgaggatgatgtgggttacacaaaacttggctgcactgcaggggggaatggaaatctacataaccaccttggaaaaatcgatatgtatcaatatgcagacgtctgcgttatcctgcagaactggacatttgcacgtaccaagcaacagccactgcaacttcacacgtaggtgctggcatgtgtgccccagacacatggacaagatgtgcacaaaagcactgtccctaacagcaaatgctagaagctccccagggctcaacgcagtatgagtcagacgaagctactgtatacagctatgtagatgatcaaacaatgaaaatcaattacctagagctgcaatcgatggggaagaatctcaggaatactctgggtcaaagaaaggtacagaatacagactgcatcgcgtaacactaaaactttcatgtattcaaaagactatgtggcatggactcctgatccatctgaactgatggtgtactgagtgatgtgactgatggtgtactgactgatggtgtactgactgatatgactgatggtgtactgactgatgtgactgatggtgtactgagtgatgtgactgatggtgtactgactgatggtgtactgactgatgtgactgatggtgtactgactgatgtgactgatggtgtactggtgtactgactgatatgactgatggtgtactgactgatgtgactgatggtgtactgagtgatgtgactgatggtgtactgactgatgtgactgatggtgtactgagtggtgactgatggtgtactgactgatgtgactgatggtgtactgagtgatgtgactgatggtataccgagtgatgtgactgatggtgtactgagtgatgcgactgatagtgtattgactgatggtgtactgagtgatgtgactgatggtgtactgactgatgtgactgatggtgtacggactgatgtgactgatggtgtactgactgatggtgtactgagtgatgtgactgatggtgtactgagtgatgtgactgatggtgtactgactgatggtgtactgagtgatgtgactgatggtgtactgactgatgtgactgatggtgtactgagtgatgtgactgatggtgtactgagtgatgtgactgatggtgtactgagtgatgggactgatggtgtactgactgatggtgtactgagtgacgtgactgatggtgtactgagtgacgtgactgatggtgtactgactgatgtgactgatggtgtactgactgatgtgactgatggtgtactgactgatgtgactgatggtgtactgactgacggtgtaccgactgatgtgactgatggtatactgactgatgtgactgatggtgtactgagtgatgagactgatggtctactgagtgatgtgactgatggtgtactgactgatggtgtaccgactgatgtgactgatgatgtatttactgacaccatctttctttaacaggggtcctgctgtcacccaggctggagggcagtggcaccatcacagctccctgcagccttaacctcccgaactctagccatcctcctgcctcagcctccagagtagctgagactacagatgtaagccactgcacctggcctgtttctttttcctccctaccccccaaatgtctcagcagaaatcaccccttttgttagctgtaagtaacaatgtaccccgtcatccatggcattagagaatgaataaaatacagtaaaagcaacatgctcttgcctctcaatgcacttgtgctctatggacttactgctactggtgattttgcaggaacaagtgaagccaatgggtttgaaaagagaaccaaggctgcctgcgcccaagtgtgctagtcatccagggccaccctgctgccctgcccaggtgctgtcacggtgggaagcggccactcatgctgctatttgtagtctcaacacttttccctcatggtgcccgaaggtagctaaacatatgcgtggggataaaaatcgggtggacaaggccagatacatgaagacatgctccactctcatctgtgaaaagtttcaatataaatgtggggactgagcattaatgcaaatagaaattttcatgaagttttcagcagttgaaccctaaaatgatttatataactaaaatgtttctagataatttcattatttggattttgaaaaaagtttcttgtaggatgacaaagcaacaaaaacttacaaacaggtgagcaaggtcctggcacagacatggggctgggcgggcgaatgggctccacagggagtgttccctctcaggtgggcagggcagggtcctggttgttgattttaatgtcctcgataccgtacatgttacatacattctttggtgttgtacaatatttcacaagaaaaagatgatggaagacagtcgcccaccctcagccacagaaccgtcacccactggcccgggttctacacacgtactcccctcttccctccctcaaaccatgcctaccatctcagccttgacgaaaagcagctgtgaactaagtaaatgtcctttgctgaggggttccccaaggagggagtgagctaaggctgcttttgggggatgttaggattggaaagagcagttacaactgtccccaggttttgcccaccagtccagtaggttttcataaaaactaggtgtctatccaaatcttccaccaacatagctacttttagtttctttctactatttcaggtattgaatctattgtcccaaccagatttgggacaggtgggagcatctggggcacattcctgacagctgaaggccacgtagggtggccgccatttccttctctgggagcagacagctgcttcagcagtagcctggggggctagaatgcccaagttcaagtctgtcctctgtgaagttacacagccttctaaacccagtttcctcatttgcaacataaggctgaagagctcagtacccactgcccagggctgctatgggcagtgaccagtgtgtttttaaggctcattcttcccaagctgcagagaacagaatgcactcgctgtggagctttctcctggaaggcagcatccatcaagcaaacgtaaagatcagaacctggcaccaccacttgactttcacgtgaaaggaaggaaaaccgcaatgagtggtgcttgctgccctttttttcagagatagcaggacaatctggaccacccacagcaaacactgcacaaggggacaatctgtaccacccataacaggacaatctgcacaaggggacaatctgcatcatccatagcagacactgcacaagaatggcagtggcaagatctggtggcttctggatgaaacaatttcttcccattatttgtcaactccccggtttagtctcaaagtgaattcaagaaccaccaccagaattaggccttttgccttctcggacatcatttgttttctaaaatgcagatctttagatctttacagtatctgacgggcgcgatggctcacgcctataatcccagcactttgggaggccaaggtgggcagatcgcctgagatcaggagttcaaaaccagcctggccaacgtggtgaagccctatctctactaaaaatacaaaaattagccaggcagggtggctcatgcctgtaatcccagctactccagaggctgaggcaggagaatggcctgaacccaggaggcggaggttgcagtgggccaagattgcgccattgcactccatcctgggcaacggagtgagactctgtctccaaacaaaaacaaaaaacaaaaaacaaaaacaaaaaccaaaaccttgacagtatccaccaggtgtctgtgcatttaacacagaagacctgacctacattttggaatggtcagggacatggcaatgcgctcgaagcccaaatgggagaaaaaccatttctgaaatcctatttggtttccaggatcctagagaaggtgccatgggcaggaacatgaaggtgcaggcttctttactctcttaagccagcggccacaggggaagcaactttgcctgccaggggccttcagcactgtctgaagaaagttttgagtatcacaactaggggcaggggtgctgccaacatctaccatgcagagaacgcaccactacaaatggcactagtgccgagtggagaagtcctgtccggaaccacgtagcactttttggttcagggttggcttccccagtgaccatcccgggcttctaaggactggctttcttccctttgcccttgtgtacccctggcttgcaagttctcctggagacatctctcgtaaaaacttaaggtgtttttaagcttgcaggttttacttgaccccagcaccaggctcccgcaggccaaggccacaccccgcaccaccctgctctattggctcgtcacaccttcaaggcaatgcaggctccaggcccttgagaagccagtccaccaccaagggccgccagacaggctcccagggcggagtctctgctgagctttccctgggttggtgatgggatttttcattcctgtggcctcctctggtcacgtgaggcccgtgatgggacacactgggtgcccctctctgtaacgggttccccaggaccacaggtgctgccaaagatattttgtgtcacataaacttagaaacgtcggtttcttgtagtagcacagattacgtgcttgtgctgagaaaagatgtcaaagaatcaaatcaacagtcctccctttcccgtgacaaaagggctaacagaggccctgaacaggttttcctttggccagttgcccaaggggactcacccaaccatccacctacaaatgtgccgcggagccttctcactgggagggctccacagacgtggcacagccactcttcagacaaaaagctctgttcccaaagagggctcctgccagaccgaagctctgctgttgagacacacgcttcatggctctgaaatccccgcagagaataccctcctgctccatcagcccaactgtttgaaagtccagggaactcgcaagagctggactctgaggggaggacaggagcgctctgctccacacctggcccaccgtggaacaccaggtacctaaggccctgggctgagggctcgcagaactgggacagtaactgagctggaagaggtcatgatggtcgccaagttcaaaacccttgttttgctcggagaaaacgagcccagagagtatgaagggacttcccccaagctataagcaaagcatgcgaaggagcagaggcctcactcagggatcacacatcaggaaggccccactgagcaacacacgtgccactggcaacagctccagtgaccactgaggggcacacgacaccacggggagcatgcattgaaattcacacaaaatcttttttttttttttttttgagacggagtctcgctctttcatccaggctggactgcagtggcgctatctgggctcactgcaagctctgcctcccgggttcacgccattctcctgcctcagcctcccaagtagctgggactacaggcgcccgccaccacgaacggctaactttttttgtatttttagtagagacggggtttcactgtgttagccaggatggtctcgagctcctgacctcgtgatccgcctgcctcggcctcccaaagtgctgggattacaggtgtgagccactgcgtctggcctattcacacacactcttgatttcagaaaccatgacccaatatgaagcaaaatttaaacaaaaggacaagatggtataagattttttttttttttgggggggacagggtctcactctgtcgcccaggctggagtgcagtggcgtgatctcggctcaccgcaacctctgcctcccagactcaggcgattctcctgcctcagcctcccaaacagctgggattacaggtgcacgccatcacacttggctaatttttgtatttttagtagagacggggtttcactacgttggccaggctagtctcaaactactgacctcaaatgatccacccatcttggcctcccaaagtgctgggattccaggcgtgagccaccatgcccggcccataagatgtttctttgtgttgagggagggtctctggacccaagactctctgaaggaagctgtgactgctttgtcagggtgtggagaacacttccctcccttttgcccagaaccagttttgggtttattttaaccagcaatgctgagttgctgttctcccttgtcaaacagaaccctggtgttgctctgtgactggtaaagacctacctcctccctgcatcatcttgtagattttgctctcaatgtggagctgagggtgtttggttttgacacattcaagcttgatggcaacctcttctcctgcagcaatgtccgtaccttggcaaagaaagaaaaccacaacaggaattacctggtatccaccaaataacccaacatgctggagaaacaacaagcactatgtgttttccatgaaggaccaagtgagggatgtgttctccttcctagcatagtaaggcgggctaatcggctgacacatctctgggggaagttatccatattcccattttcacaacaggacgaatttgaactgcacagaaagtttatgtggcttccatcacccgcccaccagtcttcaggtgctgcagctccctctccacagtggcccttctggtctgcatcctcccatcagccctgcccaaggcccctgcacttgcccgccccagacagcctgtggtagagctccacggtgccattcccttttctccatgctgcctgataggcctccgagggggtggtttgagtttccccctgaggaagggctaggtttttacccaatagccacagtcccagtccacccaggcctggcatcacaggcagcgggagtcatctctagccaacctattgcaggcaaacaccctccaccaggcggagggaggcccttctcccttcctggggacacaaagccagaagaatcgcctgttttcaacgccctaaatgtaccacctaccaacacgcaccggtcacacatctttcatcagtctatggctaaaaccaatgacacatctaataccatgacgatcggactatgagtttggaggcaaaattacactttttatctagaaatgttccatctctgctttactccaataaatgacaaatgtgacaaccaccatccctctcaggttcacccacaaatgctcctgagtttgaatctggcccaaagccttccccaaatccactgcatgaggcatccaaggagctttaaccgaacaggagagaaaaagaagctgcacacagtacatacccagctctctcctcttccctcacgagtcccttcagagtataagacactggaatcggccgggcgcggtggctcacgcctgtaatcccagcactttgggaggccaaggcgggcggatcacaaggtcaggagattgagaccatcctggctaacacggtgaaaccccatctctactaaaaatacaaaaaattagctgggcatggtggtgggtacctgtggtcccagctacttgggagcctgaggcaggagaatggcgtgaacctgggaggcggagcttgcagtgagccgagatcgcgccactgcactccagcctgggtgacagagcgagacaccgtctcaaaaaaaaaaaaaaaaaaaaaaggacactggatccttcccaacagcgtggctatgtggaaaagaattcacactagcttcagcagcccagacaaagccctgggagacttccttccctgagagactgtggtgctgggcaaagcaacttggctagttcttagtgactcggtttctcttgtcaatggagatcagtggtgaggtctgacgtctgtttcatgagagttgtggagatgaatgggttaacagtttcttttactgctctttaagataaggttccctgatgaaaagcagagtaaggtcaagtgagcactagagcagtctgctgatatccacacgtccactgaacacccaggaagcccctcgtctgcccagatggcggcatgagatgtgccacttccagcctgggccccaaaccccttgccactgctgcgttccacaggaatcgccaccaccgggtcaccgccagtgaccattctagatttaagaacgtcacttactatcaacagagactcttcagagtactcgaggtaacaaattttgttcttcctgcctacagttgggacagtctatccaattacaagagaaatgacttcatcgaaaaatgtactgtgtaaatgaaaaaccactctgagttcctctaaggacctggactctgaactcaactcgccagccgggagggagggtgactcatcccactagttatgtcagcagctccctgcacccccaagcaggcgcagtgcagcctcggacagtaccgccaccctcgccagctggcagcccagtgaccccatggcctggggccgatggcttggggccacacagtctgctgactagcatctctcactccacttctctgtagctgataaagctaatgtctgccagtcacacctgcagcactgactgtcgtggggcaaaagtcatcaccagccgctctggcacacaacacgaatcacaccctatcatggggccgggacctctcgctgtgcaagcacacagatgtgcaagcacacagagccagccctcctgtggaaccgacaccaaggtcgccccgagtctctacaggggagtagctggatgcaggtcctgtacacagatgtgaggatggcaactctctggggcctgcagcagggacctcgtcacctgctgggcagaagcatcaagaagcagaacaccaaggtctgtgcattccaaaggcaccacctgcctcaaggtcgctgagcactgctcagaccccctggcctgcagccctgtcccacctcgcccaccgggggcacccccacactctaccagccatgctgctgaaagtcagatcctcaagctgccatcagtgcacaaggcagcacagaggcgctcagtaactgtggctgcaatctggcatcgctgcagcattttgaccttatacacaagttttggcatgcaacaggttgaaaattacaagcctggttcttcaccacaggttaaatccgagaagcactactagaaggggaatgagaatttgaaagaccctgagccctgggtgtcagattcaaaacaaaccaaaacctggtgacacgcagatcaccaggttgtctgggttgtctgtttatacaaaagacattctgtcaacaaaacaaattcaactcttccctgcagctcaacaatcctggtctgctgtgagacagggctttcctcagtccgtgtttgggtatcagttaatgttagtcctacaaaaacaaaattacgtccctcaagttcagcagccaaaagcagatggtggccgggtgtggtggttcacgcctgtaatcccagcactttgggaggctgaggctgatggatcgcttgaggtcaggcattcgagaccagcctggcccacatggtgaaaccccgtccctactataaatacaaaaaaaattagccaggcatgctggtgtgcgcctctaaccccagctactcaggaggttgatgcggaagaactgcttgaacccagaaggcaggggttgcagtgagctgagatcgcgccactgcaccccagcctaggcaacagaatgatactttgtcttaaaaaaaaaaaaaaaaaaaaaaagcagatggtgagttaagcgaacctaaccagagtgtggccctgtcctggcacaggagggtaattctgaattaccagcctggatgctggcaactcccattaaggattgtcttgtcaacaaaaaaaacagggagacgccttgagcagcaggacaaaggtcaactcgcagggcagcggtcagcagtaccacgacttctcattacagatgcttgagttaaggagagtccaaggtcaacagaggctacagccctaacactgcagtgaggagaccccagaagctacaggaagaacaggtggtcgctctcctctcatggctggtcagcatcttggggccctattgcataccaggcaccctgcaggctgcctcttgagaaatcagtcagtgaggggaaaaacgtgtgcttcagagatgaagcagttagctcccaaaagatgcttgtgcacattatgaagtcagtccatccaggtaacaggtggacaaatggaggccctgacaagctgatggtgcgatgggatcaagtacagatgccaacagattcatctgtccagcccaccagccaggtaatccagtcctgccactaacctccagaacacactacaggtgagaacagaggcaggaccagctgggctctcactgcctctctgcatgggccgcctgcggggtgaacacagcaggcctctccctctagcctagcccagctgaacagtcctcttccgccagacacccctgtggttctggggctgggaactcatggtccacattaaggacactggctgttttcaaatgttaccaagtttatttccagtggtactctgccagcataagtgaaagaacttctggtttatggccacaccacatggacacggatgcggagggcggcacagggccggggccaggtcacacaacaggctgccaaggtgtgcgctccacaggtgtgtgtgggctgtgtcaccttcccaacctgccctcctgaagggccttgcggatctggcaatctcagactgaagacagattgttctttttggggtcccactttccaaagcctgggcattcaagaaatagccccaaaatactgccccctttgaaggggcaattttggaacacgacaacctggcagggccctgcagtgagcacccgccctccaactgtcacagcagggtcggggcaggcaggcccacaccacgcttctagcccacaggcactccactgaagcacagccttccccccttcctggtctcaaacatctgaaagcacagaaagtccccggtagaaaaacaagaacccaaaagccaagctcaaagcaaggtgaaccccacctggaggataccaaagtgacaacagtaggaatggtcttaacgatactcatactagaatatacacgacacacagaggtcaagatgaagacctagttcctcgatttatgtgtaactggctgcccaaacaaaactatggtggggatgaccgatccatctcatagtcttcagatcagccatctttgactctaactgccattctgctcagacccacgcttctttcaaactgccttactccggctaacgtgaccacctcgcctttcctccgtggggtcgtctgaaaggaccacagtgtaggctaggagccaatgctgatgggaaaaaaaaaaatcagctgtgcctaaccccactcaagtaactggacgtgtaccctgatgggtggctgtctgggacggctgtctgggggctccaaccccagggtgtcagagccacagccgcccgcaatcccgtatccagcatgactgtatgcccagcgcgaggtgaggcctggagggtagaatgctgagtgaggagacagccttccaccctccacctctggaattacttggtgacaaccacaccaaaatttgtcttaatctatctttggaaagcacaaagttgtttgacaaggtctcagatcagagaacagatagtttcaaagtacttcttatttatttattttttgagacagagtctcactccatcgcccaggctgcagtgcagtggtgtgatcttggctcactgcaacctccgcctcccaggttcaagcaattctcgtgcctcagcctcccaagtagctggaattacaggcagccaccaccacgcctggccaatttttgtatttttagtagagatggggtttcgccactttggccaggctggtctcctgacctcaagcgacccgcccacctcagcttcccaaagtgctgggattacaggcgtgagccaccacacccggcccaaaatactcctttttgatgcctgcctaaaggtggctaatggactggctttgcagtgtaactcagatcctggggttaaaactttcgccaaaatccattgttctataaataagccaaacgacttccattgaccaagcactctgacttcccaaacactgccaagaacacatccagctgaccacctggtataaatgtttaatagccaaacccaaatgtctaaagcctgcttactcagcagtccactaaggcatatgtacaggttcaaaagcaacaatatggcatgtgacagggtcacctggcaggttaaccaggcaccgaaagtatgagccacccatatgtgtggattcgtcctaacgctgtcagcccaccgggtcctgagtcctctctctggtgacaagtgggaagggtgtgagaactggagactgtccacatgtggcttcatctaaaaggtatgaccagaggcattactgacatcccaggggattcctgaccctagctgacaggtgccccagttaaaacacaccccaaagctagggctgctggaacagaaaacagctcccctcaaaggtctgcagcagcccctctgcaggcacaccgcctcaggctacatatcctcaaattcaggggatcttggaataactcgtgcattgcacaatcccactaacaagtgcggaaaattaagttactttaaaattacaaacttgggccaggcgcggtggcttcccagcacttcgggaggccgaactgggcggatcacttgaggtccggagttcgagaccagccttgaccaacatgaagaaaccccgtctctactaaaaatacgaaattagccaggcgtggtggcgcacgcctgtgatcccagcttttcgggaggctgaggcaggagaatcgcttgaacctgggaggcagaggttgcggtgagccgagatcacgccattgcactccaacctgggcaacaagagcgaaactccgtctcaggaaaaaaaaaaaaattacaaacttgaagatttaagccaacctttcatcacacttgtgttcacgtgcatatttttccattgtaaatatgacacaacccaaaaccttctaatcccattgtttttgaaatctaccttgagactgttacagtctaaaggacacctcatgagtacaactacctcatctgcctctcatcttgccagcatcttaatcctgtgtgactttctctacattcacctaaacttaacccttgctcatttgcactcagtcaccgctccaaggccaaggggaaccgttcagagagaacccccagcgggagggcaagccccactcctagccgggccactcccccgctccacacggcatttgggtctttctgacattttcccccacgaatgcaagacaccggggcagcctctgagggggcagccagacagccccggaccgggctgcggaagaaagagcgtggcctttgtttactgcggtgaccttaggcgtagaggaagccgacgcccgcttcgcggccccagccctaccccctcccctcccacggcccgctgcccccacccccgccctgcccctcccccaggcccgcctccccacgccccacccagcccttcccgagtccgctccccacgaccctgcccctacccaggtcggctccccagagaccatgccccaccccgggtcagctcccctatcccctccttccccaaccctcccctctccagaccctgctcccccgacctggtcctgcccctcccccacgtccgctccccactgccctccccacccctggccgcgctagcctagtggccgttgggttctggccacgatccggcggtgccgggacttgcgcggagaccccgcgggggccaccacttccttccgcgatcgcgcttggtcttggcagccgcagggcccgggtcttcgggcggcgggcgggggcggcggggcctcaccgagatagatgtctccgaaggagccgctgccgatcttccggcccagccggtacctgttcccgactctcagctccatggcggcggcggcccgattcgctcctgccctcccggccgcttcctgggtctgaactctgggaggcggcgccgctgctgccgctactgcgggtccggctcccggctccgcccccctcacggccccgctttcaccatcgctttcctgtcgccccgccgctcccagcgcctcaatacggggcggatgggacagtccgagcgccgccgccgctgctccggcccctaccggtcccgcttgccctctccccgccgcggatggactcggatcttccgggcctaaatcccctttcagctgcctaaaggagccgccgccatcgcgctgtgacgtcacttcccctagcaacccggcggggcggggccgcggcgctccaggggcggggccgggcggggcgagcgctccaggcctcctcccgaccctgcgccgtgcccagcccctctgccctcctgttaccccgggacctcgggccgccagccccttccacgtgcaggctcctgctgctctcgcgggggcttttcgtgtgtcccccgagatgtcgaggaagccaggtgagttcctcgcgacaggcggtgccctttgcaggaggggacaggtagctgaggcgtggacagagtgacaggccaggctcaggggacacaggtgagaccccctcactgggctgccagttcccgggcttggggcatcccagtacgtcagcgtctgcggccttacctcctgacacctaaggccagagacagagcaggcccgcgccctgggaggtcctgatgtccagcctgaagattgaggacaaagccaccacctttcacaaaatgaggccagaccacctgcctccctccagtccctgcggcctggagacggagtcaacattcttatctgtgttggatctgaatgttcctccttgcaaaggaaacaaggagtggacgttcaggctgatggccagcttcaaagatcggggcctttgattcccatcactgggaagaaagcccttcagacaagcccccccaggctgcaggtgcatggggaccttgaagaacccgtccccatggtcccacgtccatgtgtctcgagacctgtcgcatcctcgctgaaactcaagaatgtgaaacaggtgaaggtgtgttttgacgcattagcataccagggctgtggtgtgggcaccgccgtgtgagtgagacagcagcctcagcccgtccaggtcactgcagaagaggaaagcagcccccacaggccccacagtggtgctcgcctttctccaccccccagtctttcctctccacccctcagctccaaacagctggaggtcaggtcggggagacgggcgtccattcccgaaattacatagcagggcctggagacaggagatgccgccggccagaccaccatcagtcactaatgagggatgggcagtcggaactgcccagtttctgagttacagaagccgggggtggggggctgccagactagtaaaactgaccttgttggcggaatcgctcacggcttttctgttgatgaacagagtccagctctcccacgggtggctgtgatccttcttcctggggagtcctgctgtccctgactaggggcacctgcccacctgtcagctgctcctccctcggctggtcctcctgggctctgatggccccaacatttctagctcttctcacccatagtgccccaagcttcatgcagctgcggcaggtactgtgcccgtctgcctggcttttgtgtgtttgtgtcttgactctataacccgtgcacacggactgggctgtggtgtagtggggatggcaggagccctgggaacatgcgggctgggcaaggtgaggcaggctgattgctgtggctcccccaccaccagccccagccacaacaaactgacaaaggaagaggacagtggtaccctggagccctggggtcagagagaggaggacaaagcaggtgtgtagcccagggaatgacagcaccccttccgagaagacagggagggtgcagacatggccaggttctgagctagaaaactgtcagcagggggctgaagctgaggatagtcattgccaaggaacagcctccgtcacagaggagacgcacagatgcggtgacgagggagggatgcggggctggtgaccgctgggaacggatgtgtgaggcagagtctccaggcatggtctgtggggcggtttgatgatactagaacatctcagagtagaaggacgtcccgacctgcagactggaaagcccccagagctcccggcaggacgtatgagggccagcccacacccaggtctgtcctgatacaactgaacgccacagtgtcttagctcctttactgttgctatcaagaaacacctgaggctgggaaatttatgaagaatcatgaggtaatttgtatatttgtccacactaaacctcatgttgaattgtaaaccccaaggctggaggtggctgggtcatgggggtggatttctcaggaatgtttagtaccatccccttggtgctgtccttgagatagtgagttctcctgagatctggttatttaaaaagtgtggggcacctctctctctcgctcactcgctcgctcgctcctgctctggccatgtgacgtgcccgctcccccattgcctttcaccatgattggaagcttccggaggcctccccagaagctgagcagaggccagcaccatgcctcctgtaaagcctgcagaaccaggagccaagtaaacctcttttcattatttatttatttatttatttatttattttgacacagggtctcgctctgttgcccaggctggagtgcagtggcgtgatctcggctcactgcaacctctgcctcctgggctcaggtgatcctcccacctcaccctcctgagtagctgggactacaggcacacgccaccatacctggctaatttttcatattttttgtagacatggggtcttactggcccagactggtctcaaacttctgagctcaagtgatccatccaccttggccttccagagtgctgggatcacacgcatgagctaccatgccggccctcttttcttttaaaattgcccagtcctaagtatttctttatagcaaggcaaccacagcctaacacagctcacgatgctgaggtctcaaaagttcaagatcgggcgtctgcctctagtgagggccttgctgccgctgcctccactcatggcagaaggtgaagggcagctggagtgtgtgcagaccgtgtgcgagagggagctggaggagtagggaagtacaggcctttttttttttttttaagatggagtctcgctctgttgcccaggctggagcgcagtggcgcaatgccggctcactgcaacctccgcctcccgggttcaagcgattctcctgcctcagcctgctgagtagctgggattagaggcatgcgccactatgcccggctaatttttgtatttttgtagagacggggtttcaccatgttggtcaggctgatcttgaacttctgacctcgtgatccgcccgccttagcctcccaaagtgctgagattataggcatgaggcaccgtgccggccgtgcaggtgtttttaaaagcacctcttgctggaactagtaggagtgaaaactcactcattactaagaggacagcaccaaactgttcgtgaggaatctgcccccatgacccagacacctccaacactggggctcagatttcaacctgaggtttgaaggggaccaacacccaaactatagaaacagagaaagaggaaagtttacagatacccatttagaaagaatctgctaacaaagggaaagaatcaggctgggcgcggtggtttatgcctggaatcccaacactttgagaggccaaggtgggtggatcacctgaggtcaggagtttgagaccagcctggccagcatgtgaaaccctgtctctactaaaaatgcaaacattagccaggcgtagtgacgtgcacctgtagtcccagctacccaggaggccaggcaagagaattgctggagttcatgagacagaggttgcagtgagcagagatcctgccactgcactccagcccaggcaacaagagcgagactgtgtctcaaaaacaaacaaacaacaacaacaaaaggaaagaatcagactggcttgggactctgctgtcccctgcccgtgacctcccaaaagcgtgtgttagagactgacctgcctagtgcgtcagtggagggggcactttggagaggggcttggatcgtgaggccccgccctcgtgaatggctcagtgccttgtgaaagggcttgatggagggagtttggtcccttttccccttttgtctctctgctgtgtgaggacaccatgttcctcccctctggaggatgctgtaacaagctgtcatctcgggaggagacaccaggccctgaccagacgctgaacatgccagcaccttcatcttggactttccagcccccagaactgtgagaaataaatttctgttctttataagtacctagtccatggtgttttgttacagcagcatgaacagactgagatagcggcttacatgtaaccggaagctgcagaaaaacatcttcagacagctgagacggctcccaggactcgtgcctggcacagacaccatctgcctggcagggcaaagaaaggcgtctgtgagtgtgggaggattccgagtctaacaccctgagcccagccaggaaggggccaggaaggcctcctcgtgaacaacgaatgaaacagatcccagatctcagacagggcggggaaggggaggggtaccatgtcaagcagcactctgtgtaagtcggcacctgcgcacacttgcatgcagacgtgtgtattgtgagtgtatggacatgttagaaatggatgtgtgcatgtgtctgcatgtgtttgtgcatttatgcacagacactacacgggcatgcacatcatgtacgtatatgtttgcatatgtgcacgtgtgtgtacgtgcatgtgttcgtgtgtgcatgcacacagcatgcgtgtgtgtgtatacttgcatgcatgctaacatatggtggagaataaataatgatcacctctctggaactggggaaagtaagtgttaaacagattttcgacaggaaatgctgctgcaaggaattcgtccgtaggctagcactacaacctggaggcagggagcagtgaggagtggaagtcttcccatcagaagtgaggaaggctggatacggtggctcacaccagtaatcccagcactttgggaggcaaaggcaggaggatcacttgagcccaggagtttgagaccagcctaggcaacttagcaagaccttgtcttaaaaaaaaaaaaaaaaattttacaaggaactacacagatggcaaaattaaaaaaaaaaaaagtgggaagaggggagaaagggagatcaatgtcttctacagatttcatcttatcgggtggagggtgtgaggagtagagccacgtggtgggaaactgttggtgtcttgtttgcgaatgactttggaacaaagaccacctgataagcacagttaaggaaggaaaacacacagggacttcccagggagccaggaggacactgggggagcaggaacacctgcctttcccatggggccctggtgtgcccagccccccacttcatgtctgacccacgtgctctccggctgacctcctgggactcgcacctggcccccacttggtatctgagccacgtgcttcccggccctcacttggtatctgagccatgtacttcccggctgacctcccgcaacgtgaagactactctcgctcccttcaaggccactgtccccaccgcagccagagaggtgttttatagttcaaatcctgcccaggcaccatcttgtctaaaggcagccctgagccggaatctgtgtgctttgctgatgggactgtaaaatggcgcagtcacttttgaaacagtctgacagttcctcaaaagcttaaacatagacttaccacatacccagcaattccacgcccaggctctgccccaggagaattgaaaacatctatccacacggaaacttgtacacaaatgttcacagttgcactatttatcatcatcagaatgcctataattgatgaacaggtgaacaaattgtgctatatccatataattaaatattattcagtcataaaaaagaatgaggccgggtgtggtagctcacgcctgtcattgcagcactttgggaggccgaggagggcggatcacaaggtcaggagatcgagaccatcctggttaacacggtgaaaccccgtctctactaaaaatacaaaaagaaattagccgggcgtggcagcgggcacctgtagtcccagctactcgggaggctgaggcaggagaatggcgtgaacccaggaggcggagcttgcagtgagccgagattgcaccactgcactccagcctgggcgacagaacgagactccatctgaaaaaaaaaaaaaaaagcagcacatgatgctcagcagcagcagaagcaagtctcaaaagaccatatactgtgtgagtccatttacacgggatgtgcaaaataggcagattcatcgacagagaccttggatcggcggtcctcaggggctgggtgggatgtggggagtgactgctaatcgggagggggtttccttccctttcgagacggtgaaaatgtttcagaactaggcagaggtgagggttacataatattgcgaatatactaaaatgaactgaattgtacacttttaaatagttaaaatgatgaattttgttatgtgaattttgcctacatttaaaaaaaaaaaggccaggtgcagtggctcacgcctgtaatcccagcactttgggaggccgaggcaggtggatcacaaggtcaggagttcgagaccagcctgagcaaaaaggtgaaaccccatctctactaaaaaatatgtaaattagcccggcgtggtggtgcgcacctgtagtcccagctatcgggaggccgaggcaggaaaatcgctggaacccgggaggcagaggttgcagtgagccaagattgtgccactgcactccagcctgggcgacagagtgagactccgtctcaaaaaaattaattaaattaaatttaaaaaaaacccaacctaggcaactagtgagaccttgtctctacaaaaaaattaaaaattagccaggtgtggtggctcacgcctgtagtttaagctactcaggaggctgaggcagaaggatggcctgactacaggagtttgagaccagcctgggcaatatggcgaaaccccatctctacaaagaatacaaaacttagcccagcgtggtggcgcgtgcgtgtgattccagctactctggaggctgaagtgggaggattgcttgagccctggagtttgaggcttcagtgagctgagattgcatcactgcactccagcctgggccagagcaagaccctgtctcaaaaacaacaaaacaaagaggctgggcacagtggctcatgcctgtaatcccagctacttgggaggcagaggcaggaaaattccttgaacctgggaggcggaggttgcattgagctgagttcacgccactgcactccagcctgggcgacagagtgcagagcgagactctgtctcaaaaaaaaaataataaaccaaaacaaaacccagaaacaaaaacaaccaccaaaacccatcaggtagccctgagtccagagccaacttcaaccaccaaaacccaccaggcagccctgagtccagagccaaattcaaccaccaaaacccaccaggcagccctgagtccagagccaacttccttgctgggttagaggtcctcacctcctgccctccccgcaggaaccacttgcagcttcctgaaggcatcaatgtcaccccgcccctgagcctgggggtgatgaaggtggatgagccagccctgcacaggtgaaggccactgacagctgcacaaggggggctgcggtttgcagcttccagcagcttccagggggaggggacctcagcccgatgaaggatgccagcgtggaggttcccaggtgggacctgggggtggtattccaggagctagaggcaatatgtgttcctgcgtgtgagcatgtatgcgtgtgtgcatacaagtgtacatgtgtgtgcacatgtgcatgtgtgcccgtgtatgtgtgtgtgttcatgtgtgtccatgtctgtgtgtctgtgtgttcatgtgtgtccgttgtgagcatgtgtgcatgtgtccatatgtgtgcgtgtgtgcctgtgtgtgcatgtgtgtccgtgtgtgcctatgtccgtatgtgtgcatgtgtgcctgtgtgttcctgtgtgtgtctgtgtgtgtgtgtgcctgtgtccgtatgtgtgcatatgtgcccgtgtgtgcatgtgtgtgctgtgtgtgcacgtgtgcgtgcatgtgtgtccgtgtgcatgtgtgcatgggtgtccatgtgcacgtgttcacgtgtgtgcatgcatgcatacatgtgtgtgcgtgtgtgtgttgggcaaacctctcacccacctgctggccaagggtaactctaggaagtgctgggatcacccagggctggggttagacaggtgcacaggtagagctgaggaattcagcccttcaggttcccagggctcctagccagcactggtgactaattgggcagaggcgagcaatgcccagcccacgccaggaaggaacggaagtgagttcatgtcccacctcccacgacttaacccaggcacagacgaggccaccacgaaggctgggactgtaatgaggttgccctagaggtgccctgtgcaatgcggcagccgccaaccacgtgtggttatttaaattaattaaataaaagtaaaaagcagttcctcaggctcctaagccacatttcaagtgctcagtgatactcggagtgctcagggctgctggagaccagtggtctggaccagaggtgatttcgttccccaggagatgtggctgccgccagagagaatggcctggccatgagtcagtagggctgaggcggagacctcctaccccctgccccagacccagccctgatttgtgccctggcagcatccagggtaacagctggctatgagggagagctttccatgcatgtggctcctgccatgctggtttacctggtcaggtgagggtgtgagccttgaagaagccaggtgggaggagggtttgattgcgctggccctgggtagggctaagggtggcccacgtctgtggtcatggcacggcagggggctgcatgcccctgatggagttgcttcccatcagacattttgagtcctgagctgggaacctgttgggggtggaacctgccccgtacctggaccctcacaccttctcccacctagcccatgaggtgatgggccatctgggctgggtgttgccccagtttttgtgtccagaggttttccagggttcccaggcccagccctgcgtccctggctcaggagcaccctccctcagccctggggcccgtccttagctcggcagccctgggcaaatcgtgtatcccctagtcagcttctccagggtgaccggcagtgactgaagtccctgttccctgttccaccctccctgcgcagggctgggcacaccgggcgccgtcagtacactgtctgcaatggccgagaaggcagcgctccatgcaggaggaacgatgcgtccttgccactgccctcatttgtgacttgggacagctgctcccagcaggatggtgtcctttcctccagagccaggggaggagtgaggcctggtgcccgggcggtacctgcctcacccaggtcgcagagagctattcctcggcagcctctgccactggaggtgtgggcaggtggtggggtgatgcccacacgagtgcagtggatgcggccctggcccagcctgcaggaagttggaggggtccccatcagagctggggctgctgccccccattcccctcccaccaatgtgtcagggcaaaactggaagggtcatgcctgtccccagctcccagaggtctcgtttctctctcgtggctggcacagagccagcagagaggcccagcctgcatgctcttcagcgccccaggcatcatcccagccggctggggagcgtctgtgcccagatgccctcgacatccctcttctctgcatctcacagctttgcggggtgactgggcatgagtcatcagccgctgaggcctcccacctgccccaagtgagcacggcctctgcaggggccacccagtgaatcggcagccatgggaacttccctagcacctcctccccagggtgtccacccaggccacctcctttctctgccgcctcctccaggcaggacatcccacccaacttagctggcagagctctagaggtcaggctgagtgaccaggtaacacggggtagccctggccagtcccaagcatgttccctggggaggccactgggaggtatgtccctggggctggagcaggctgagggcattctgggtcaaattaaggcaagatttgggacctctgaaacagagctctgagcacatgcttggaagctgggggcgggtagaggagctgctgggagggcccagcacagtgcgggatgcaggatgcgggatgcgggatgctcagggagggacaaggagggacggccgcacaactgttagagctgtgatgacgtcgaggaacagggaggcattgaaggcagctgactccagaccagctctgtctgctctaacgcagcactgaagcatccactcaaggcaggcaactcaagtcagagcagacccaaaggaacaaagaggaaaaaattaaaaaggcagaaagcaggggccgggcgcggcggctcccgcctgaatcccagcaccttgagaggccgaggcgggcggatcaccaggtcaggagatcgagaccatcctggctaacatggtgaaactccatctctactaaaaatacaaaaaattagctgggcgtggtggcaggtgcctgtagtcccagctactcaggaggctgaggcaggagaatggcgtgaacctgggaggcggagcttgcagtgagccgagatcatgccactgcactccagcctgggtgacagagcaagactccgtctcaaaaaaaaaaaaaaaaaaaaaaggcagaaagcagtgggggagggagagggaagaatgaggattaaaaacccaaaaactggaccgggcgcggtggctcacgcctgtaatcccagcactttgtgaggccgaggcaggtggatcacgtgaggtcaggagttcgagaccagcctggccaacatggagaaaccccgtctgtactaaaaatacaaaattagccgggcatggtgatgcaggcctgtaatcccagctactcgggaggctgaggcaggagaatcacttgaacaggggtgggggtgggggtggagattgtggtgagccaagattgtgccattgcactccagcctaggcaaaaagagcgaaactccatctcaaaaataaataaataaataaatacaaaaattagctgggcctgtagtcccagctactcgggaggatgaggcaggagaatcgcttgaacccgggaggcagaggttgcagtgagccgagattgtgccactgcactccagcctgggcaacagagcgagactctgtctcaaaaaacaaaaaaaaaaaacccaaaagctggggcgtgggaggaatgaccccgtgaaagcaccctgcaggaatgaagaaaggaaaacgcaagacagcacaaacaaaacacaagaaaggaagggactgcagagttttaaataatagaattggaaacatttacaaaccaataacattgaaaaccgacatgaagttgctaaactcctagagaactataaaatgagaaaaacaaaacaaaacaaaggcaaaaaactgaatagattaaaagtgtgtgttggggccctcccctcctccagcacggggcctaggctgctgtttgagtgagttccactgagcttcccggggccagttgattcctgtcttggacaaaacgttccagaaagtcaaaagagtgggatgtgtccagcccactttataaggctaggatgacagcaactccaaaccaacaagaacagacaaaagcagaacatgagaggcccgtttcactccggattttaggtgcagaaaatacgaaataaaatattaggggccaggtgaagtggcgcatgcctgtaatcccagcactttggcaggctaaaagggcggggatcacttgagcccaggagttcaagactagcctgggacacatgctgagaccctgtctctacttaaaacaaaaaaaaaattaaaaattaagcccgggcaaaacagagtgagactttgtcgccatgaaaaaataaaaaaaattagccaacgtggtggcgtgcacttgcagtcccagctacttgagttgctgatttcgggaacatcacttgagcccaggagtttgaggctgcactgagccgtgatcgtgccactgtactccagcctgggtgacagagtgagctcctctctctaaaaaaaaaagaaaagaaaaaagaaaaaatttgaaataaaatattggctaactggacctcatggtctgagtttctctagtttaatatcagacgatatcagtgcaatttgttccgccaatacgctacagaagaactctaactcaggcatagaaaagcattagatggaatataattgatttcacctactttgtttatgattaaaaagctcttagcacaatagacatacttttcaatggtacaggttagacacccatgtccacaacaaccacgtatatgatggagaaacttcagtggctgagtccatgaccaggacaaaatgcccaatgatgtgctcctggttcacaccaggagcctcagacactcacgtggcctcagagacacacgatccagcaatcgtgctctttggcatttactcagctgggttgaaaacttatgcctgtacaaaaatcttcatgtgaatgtttatagcatctttattcatcattgtccacaactgtccaaactggaagcaaccgagatatcctttctttggtatcagtacatccattcaatgacataagatagaaggtgccagcacgccacaccaaggcatgcgtgaattgtgaatgagggtgaaagaagccagtcggaggctgggcacggtggctcacgtctgtgatcccagcactttgggaggccgaggcggacagatcacctgaggtcaggagtttgagaccagcctggccaacatggtgaaaccctgtctctactaaaaaaataaaaaataaaaaaataaaaatttagccgggcgtggtgctgggcacctgtaatcccagccactcgggaggctgagggaagagaattgcttggacccaggaggcagaggttgccatgagccgagatcacaccactgcactccagcctctgtgacagagtgggaccttgtctcaaaaaaaaaaaaaaaaaaaaaagaggagagagggaggggtgaacaggtggaacacagaggattttaggacagtgaaatgattctacgtgatagtgtagtattctactataatgtggtagtattctactataatgcggaatacacaaaactacacgtgtcaaaatccatagactgtacaggagagagagttggccttaaggtatgcaaatttaatcacttgggagatggaggatcccagcatggaattcagactgtgacaagagactctaactgcattacagatgcatgggtgcactgtctgcaatggctgagaagccagcgctccatgcaggaggaatgatgtgtccttgccactgccctcatttgtgacttggacagccgctcccagcaggatggtgtcctttcctccagagccaggggaggagttaggcctgatgcctgggtggtacctgcctcacccaggttgcagagagcctcacggcagggtgctgacctaagtaactttggacacgcgtggagtctgtaggactaaagacagaggatgtcaacacttcctctaggtgataaaggcatttcccacggggataccagctaataattctgaaaccactatacatctactctggaagtgaaaaactgagtacgtggtggcaggtggtaggggtcaggtttctcactatgggaatgggagcttccagataaacaaatggaaaggctagaatgatccatgtggtaacagaattagagacattggtataatttcatgcttaatgtagctacttctggatatgtgtacaaacagatgtgtatacacacagcttcgtatacacacatctatctctttgttctgtcagctgagaagcaatgagcacacttagccttcagatcttggtctctaagacccttctccagttaaaagaaccacaggtccttggctaagtggctgatttgaggactggaacagcaaatacataagatgatcctggagtgccttgcagtgctagtgttatgggctgaatttctttgcccccaaatcacaggtggaagccctagcccccgatgtgactgcatttggagatggagcctttgaggaaatgattaaggttcaatgaggtcatgagggtcaggggccctgatctgattagattggtgtcttttttttattcagtagaggcagggtctcactatattgcccaggctggtcttgaactcctggactcaagtgatcctcccgctttggccttccaaagcgctgggattacgagcatgagccaccacacccagccaagactgttgtccttatgagaacaggaagaaacaccaggagtgagcatgcagggagaggccacgtgagcacacagaggagaggccacgtgagcacgcagggagaggccacatgaggacacagggaaaggtcatgtgaggacgcagggagaggccacgtgagcatgcagacaggctataggagaatgcagggagaggtcacacgaggacgcagggatgctgtctgtaagccacagagaggcctcaggaggaacccaccctgccggcagcctgatctcagacgtccagactccataactgtgagaagagaaacacctgttgtttaagctgcccaggctgtggcatttagctgtggcagccctggtaatatagttagaaggtgaagaagtgatcgaaaaacaaaaccagcaccgtgttggctcataacttgcagcataaatctccacaagtccgtaccgatataaggaaatgactgagtaaataaataagtggggaggagagatgaatcacaaaggaattccaagtagtttgtgtagacactctgcccctaaggaggggagcctaacccccacaccttccttgggtgctgcaaatactgacttccccaccaagggcaccatgtggaaagggggacttcgtggtggagaaacctgacaggctccgcattggccaggtaacccaggccagccccacctgtgacccggcaggtggagaccatacacccttggtaggctgcgatgaggacgggacttcaaccctgcggtcttcctcccaaaacccatatcccctgtctaaccaggagaaagatatcagaccaatccccacagagggacaccctccgacacacctggccagcgctcctcaaaactgccaaggtcatcaaacatgagagaagctgagaggagcctgagacccgaggactgagtgtccaggatgggctcctgggacaggaaaaggacagcaggtgaaactgaggcaataggaatcaagtgcacaccttagtcaattacaatgtgtcagtattggctcattaattacataacaaacaccaaactaatgtcagatgttaacaacagtgccctcctatctatcttcacatcttatctggaaacccagatctattctaaaataaaacatttatctaaaaataaaaaggaaaaagttgctgtaggttcctgattgctcccatagcaggttaggctctcccccgtcgttcctagcttgctaatagtggtaacaacaatggccatttaaatctaccatctcaagatggaaaaaacacatgtacacaaaacgcagtggaagggctggctacgagtcagaggaatgacagcaaggatggctgaataacaaagaaacagatgaaatcagaggagccttgcctgttctgaccatattctacacctgggaccctcttcgggaggcccagccaaagaaagaaagaagggccaggtgcggtggctcatgcccgtaattccagcactctgggaggccaaggcagatggatcacctgaggtcaggagttcgagaccagcctggccaacgtggtgaaaccccatctctactaaaaatacaaaaattaactggctgtaatcccagctgctcaggaagctgacgcaggagaatcgcttgaacccgggagacaaaggttgtggtgagcagagatcgcgccactacactccagccttggggacacagcaagactccatctcaaaaaaaataaataaaaataaaaaagaaggaaaccggctgtggattgtgttaagttaaaaatcacaagatctatacactcagaaaggagactttacttcttataaagtcttatagcctgtaaggtggccattctgacaggctaggaagtgtggcctccagcctaaggccagagacaggtacttggagggagggtgcggtgagacaggaatgtaagccgaatgggttggtcaggtatacatactcaacaagttacaggaggcgttgcgaatatacatgcatgtttattcggacacgtgtgctggataaacatgcatgttacatatgacccatgttcaccttggggtgaaggcagcatgtaagcgtattacaattaggtggtatacctcaaaaagtactttcaggacatgaaggcacatgagggtgcaatctctgtaaaccagccagaacccgtctatggtcagggtctcttatcagggaaaagttactgaaacgagtctcttgtccaaggaaagctctagttacggctggtggagcaggggtgtggggccagggtcggcagggggaggagctgcggttgtttcaatgctgcttatcttgaggctagtgcttgtttagctgctacagaaaaagagaaacctgcggcctttagaacagagttgattcttcacgtgcagggatgcacgacttactttcaccaggcctggcctgaggtcctgtttataatttggtattttattgccacagagcctgttcttagtcttatgatctctattttaacatgaacaccggtcaattctgtctaaaccacacaagggagggggtagaatgaggtgcctctgacctaccatcccgtcacggctggaaactcagttttttggcttttttttttgagatggagtctcactctgttgcccaggctggagtgcagtggtacgatcttggctcactgaaacagattcaagcaattttcctgcctcagcctccagagtcgctgaaattacaagcatccaccaccacacctggctaatttttttgtatttttagtagagacggggttttgccatgttggccaggctggtctcgaactcctgacctcaggtgatccacccgccttggcctcccaaaatgctgggattacaggtgtgagccaccacgtctggctggaaactcagtttttaaggtgtctctgggaccccttggccaagaggggtcttttcagtagttggggggcttaggatttttttttcttttttttttttgagatggagtctcattgtcacccaggctggagtgcagtggcacgatctcaggtcactgcaacctctgcctcccaggttcaagcgattttcctgcctcagcctcccgagtagctggaattacaggtgtgtgccaccacgcctggctaatttttatgtatttttagtagagacggggttttgccatgttggccaggctggtctcgaacccctgacctcagggtgatccacctgcctctgcctcccaaagtgcggggattacaggcatgagccaccgtgcctggccaagattttatttttagtttacaattggaaggctagtgggccggtgcagaatctcgctgacttttgggtgagcatgttgagggccccctgcgtcagctgctcttctgttgaacggtgcagggtggggaggcctgggctgcactggccacacagtcccctcaagaagatcttctacgtgaaacaaaggagcactgagcgaggggagctctgctcagaaaggaccatcttgcatcactgaaattgtgggaaatgataacaaaaaattgaaatgtcgtgaagaaacacaccaataagaccatttttaaatatacagaggaagctagaaaatacagaaagaggaaccattcggacaagatactcaggaaatatccaggattgttatacctaaaacagccctcactgcccccctcctggcagcgcacctgagcccggagcctgccagggacagctctgaggagccaggcagggccagggatgggctctgaggggccaggcagggctagggatggactctcgtgcctgcctgcttgaggcttccttggtcagagcgagcgatgccacctttaggatggccagaattagcaaataaaaatatgggatgccgataaatctgtacttcagataaacaatttttagtacatgcccaacgcggtagaggtaaatctataggggctgaagcagatttgctgggccgtgggcagggtggggagtgaacgctcatgggcacggggtttctttctggggcaacagaaacggtgtcacatgagatagtgagcatggccgcccatctccgaatatacggcaaagccataagctttcaataagtgaatttcacagtaagtgcattatatttcaacaaatctgttttaaaatcttaactgagccgggcgtgctgtctcaggcctctagtcccagctactctggaggccgaggcgggaggatcgcttgaggccaggagttcaagaccagcctgggcaacatagcgagaccccatctctacaaaaaacacgttaaacaaaaacgttaattgggcgttccgtgttgtatccagcaatcctaaccgccctccgtccccgcgagccccagtccttcccctgcggctgggctgggtcccccgtcccgggcggtgagggcgccctgcaggcgtccacagagctgggcttccgtggcggcaaccctaaccccagcgccacctggtacggcccggcccgcgggtccctccgggtcaggacgcagacgcgcccgcggcggtaaccgggggcccgggggcctcgggcccaccccggccagaccccggggaggagcgcaggacactgcccgcgccgggactcggctgtttccgatcctcccgggcgtcctttaggagactcattcgcagccgacgttgcggaggcgcaggaaaagggcgagcaggtgcctcagggacaccacttccaaccgcacgccgatcgccggctccaccataaatagaaacgggtggtctctaattggcctagctctaattggcctagctgttgtcacgtgctctccgatggcccaatcactaaggctggacgatgctgcactgtgaatggccaggcccgagtcatgtgcccggagagggcggggctgggcccttccgctcgccgcgtctggcgatcgcggctacggagacccaggagggcccggccaggagacccgctctctagagcggcgagggcaggggttgctagggcgccggggtcgaacccgcgcttcctgcaagtcttagggccgcatccctgccgaggcgggcgttgggaagggtgggagatgggaaggtgcggtggtgcggggaggggagggcgccgggaggggtcggagaggggtcgcgggttttggggctgcgaggagggaaggagggaagaggagggaagaggagggcaaggggaggggagggcggggaggagagagggcgcgggcaggggagtggagggcgcggggaggggagggcgcggggaggggagggcggggaggagagagggtgcggagaggagggcgggaaggagaggggacggggggagggaggggacggggggagggaggggagggtgggggaaggaggggaggggagggtgggggaaggagggaaggggaggggaggggaggagagggcggggaggggaggggagggcgcgggctgcggggctgcggggagggaggggcgggttcagggctgtgggccccgcccggggcaccgcctggatcaggcctgaggccggctgcagagaacttgggcaccgcggaccagattgctggtcaccaggatgaaaaataaaaaagacccaaacagctcccccgaccccgccttcgcgcaggcccctggcgttctgctcaggggtttttgtttaatgaagaacgtcaaacatctggcaaggtcggaatgattttgcgatgagcaccgcctggattctgcggtgaaagcgactgtgtgcgcgctcacggcctcgcctgtccctgcatcagcccatctcgtcaggcagatcaacatgaagctgtaaaacggatgacttaggccgggcgtcgtgatgggcgcctgtaatcccagctactcgggaggctgaggcaggaaaaccgcttgaacctgggaggcggaggttgcagtgaaccgcggttgcaccactacactccagcctgggagacagagcgagactccgtctcaaaataaataaataaaacatatgacttaggtatatacgcatggggggaatcctcgtaaggcaagaacgtgctgcacattctggggactgggacaggataagcacacgagtagatctaagtcactggaaatacctggttttgctgttggaggggggcttgcaggtgctcgttatattattacgctgttgtagtaaaacgatgttagttacagtattaaattgcaaatgtcagtatccatcaccgccaaaacagcgtgcataccactagcatatgatttttgtagttttttaatgttaagtttgtaatgaagtgcacaaacttaattatacattggctgaggttatttgttttaaaggcagtacttgctctatggcccaggctggagtgcagtgcgtgatcatggctcactgtaacctcaaattcttggcctcaagcgatcctcctgcctcaccctcctgaaaggactgggattacaggcgtgagccaccatgcccagcctccttttgctgagttttaacaaatacagtagtgtaaccgaagatgccatcaagacaaatagaacacgtccctcaccccagaaaattctcttatgcccctttccattctatgtccactgctaccatgccacctgtgctgatttctccactatgcttccgcctgttctaagagttcatactaatggatcattgggtacatgtccttgtgtaaggcgtctttcccttagcgtcatgtttctggagattcttctgtgttgtttcatgtctcaggagtttgttcttttgattgccaagcagtccagtgtaaacacaccggtgtgtttatctgctgtattcatggacacttggagctgtgtctggctattggcgatcacgaataaagttgctgttgactttctttttgaagtctttgtgtggacatgtttttatttctctgggcagatactgaggaatgggtcaaaggaaaggagtatgtttggttttatgagaagttgccagatttccccactggctgcttccatattagtagtggagtctgagtcttccatttcctccacatcctcacagcacttggtaatgccagcgtgtgtgtgtgtgtgtgtgtgtgtgtgtgtgtgtgtgtgtgtgtatgtgttgtagccgttttatttattttttttgagacggagtctcactcttgacacccaggctggagtgcaatggcgtgatcttggcttgctgcaacctccacctcctgggttccagtgattctcctgcctcagcttcctgagtagctgggattacaggtgtgcaccagcacgcccggccaatttttgtacttttagtagagatggggtttcactacgttggccaggctggtctcgaactcctgaccgcaggtgatccgctcgcctcagcctcccgaagtgctgggattacagacgtgagcccccttacccagcctggtaaccaccattctactctcctactaattccacttttttgcactccacatgtatatcagtgggatcatgcagatttgtctttctgtgcctggctcagtgatgtccttcaggttcatccgtgttgtcagcaatgacaagatttccttctttttaaaggttcaatggtattctaaggtgtaaatgtgtttttttctgtgggggataggtcagagtggtgtgaaaaactatagggaaaggacgcaaaccttctgaaagggcggagggttctgcagagctcccggggagaatagctgaaggcagctgtcctacaactctgaggcagagggcaaggagttggtacaaaggagtgtaggggaatttatcttaaacaggcttgtttacttatgttgaccaggaactgacctttgatcatccgtccaacgttccctgaaaggggaacgataaatgttaattacctacaggttgtgtgggctccaggttttcggcattgtgcctgcactgagtaaaagcagacagtggccgggcgcggtggctcacgcctgtaatcccagcactttgggaggctgaggcgggcggatcatgaggtcaggagttcgagaccatcctggctaacacggtgaaagcccatctctacctaaaatacaaaagaattagctgggcgtggtggcgggcacctgtagtcccagctactcgggaggctgagccaggagaatggcgtgaacccggaaggcggagcttgcagtgagccgagattgtgccactgcactccagcctgggtgacagagcgagactccatctcaaaaaaaaaaaaaaaaagcaagcagctccagcttctccaggctgttctctggccactagagccaggcagccccctagctggtcttacactgcatacctgtgtctgagtactcatttcacccgtcggccaggatctgcgggacagacccggcattcttcgttatccattcattcgttgacggacacttaggcgagttccgtaccttgattgcagtgactaatgctgccctaatggcatttcattggaaatgaactattacaggagggtttttgaagtggcttatgatccagaaaaggaatcttccaatacctctgtgccccaaaaccttgggtaaaataccaacagtgcagttggtctaaaaggcaccacttaaattgcgttgcagatgacgttgctaaggatggctttctggtctcctggttctgggcagctccctgcactgctggtttcagtcatgttgcaaggagagtattagcaactcagtagtgatgaggtttagtggacattttatttaacgttctgtca

SEQ ID NO: 2 - DNA, 822796 bp, Homo sapiens
  misc_feature (359913)..(424912): n is a, c, g, or t
tcacgggttcatttgtttgatgaatttgtcataacttgaaaggctctggtttatatgctaacttcctgttccagttcagtgccaacataaccacaggcaggttaattgcgtgtccatcaacacgcctggggagcgagccaagccctccctcccgccttcatggccacagagtcctgctgccagagcgctccaacccgtgggcaggggctgtggtgagtgccagccccacaggaaaccccgtgtgccaggtgccacagccaggcctgccctgggctgcaggccccccgttcttcagtccttcctgtgaagtcgtccagctgggggtgggaagggaggtgcctgtgactgctggagagactcatccagccaccctcaaccaataaaatgctcttcacccagcaattctacttccagggatctctcccaccaccgagtcccaccagggtgccacgatgtagaggcaggacatttgtgggaaggtgccggcggctcctggggctggacacaggctaaatgcctgggagggggcggctgggtaagggagaggtgagccgaggccatgcagcctggtagccatcgagaagaaggagattacgtggacaagtggttaaagactttctaggtgctgctccgggacaaaggtgaggtgccacccccatgctgtgtgtgggactttgctaaaaccagatgggaggggaatggtgcctggagggtccctgcactgtataaccttctatgcctttgaggtgtaaaagcagtgttgttttaccttcctaaactgctgtcacaaatttctacaaagttgttcatgtaaaacaacaaaattccattctctcacaggcctggaggccgcaagtccagaatcaaggtgcctgagggccgtgttccctctggaggcgcccggggaggcggggttgggggaatccttcctggtctcttccagcttctgggggccacaggtgctcctggacttgcagccccgcatggctccagcctctgcctccacctccacgcgccttctccgctctgggtctcagtcatcctctggctttccctttctccgatgcctaagtgtcatcggatttagggcccagcctaagttcaggatgacctcatctggaaattagatgtcaatcagaagctggaggttcatggggcccccactctatgaatgcagggtctatgtcccggaaggaggtgacagtccaagcaggacctggacgtctggacacctgggaacccaggcgtctgaacacttggagcctggacatctggacgctaggacacctagacacccccacaatgcccctttccccaagcccaggcttccccaactggcctcgagtccagggcccacaacgaggagcgggtggtggtaagaaggaaggtggtggaaaccaccactgaggcatcgatgtgtatttgagacctcagaaccaagtgcagccgagcgcgtggaccatgcagagaccagccggccaggccattggtcccagactgcacccctggggaggccccgcccacctcgtgtggcactttcccacgtggcaaccccaaagccagcaggtgcagtgtttgagtcaggctgcctgggctctgtccacagctggggggccttggacgagggacctctggtgctcatttggacagcagcatcatggtggctgcctcagggctggtgggattacctagcaggacagcccagggctcacctttctttctttcttttttttttttttgagacggactctcactctgtcacccaggctggagtgcagtggtgcgatctcagctccctgcaagctccgcctcccaggttcatgccattctcctgcctcaacctcctgagtagctgggactacaggcgcccgccaccacgcctggctaattttttctatttttagtagagacggggtttcaccgtgttggccaggatggtctccatctcctcacctcatgatctgcccgcctcagcctcccaaagtgctgggattacaggcgtgagcccccgtgcccagcctccttttttttttttttttttggagatggaatctcgctctgtcacccagactggatggagtgcagcggcgcgatctcgcctcccgggtttaagcaattctcctgcctcagccttcctagtagctgggattacaggcgtgcaccaccacgcctggctaatttttgtatttttagtagagatggggtttcaccatgttggcccaggctagtctccaactcctgacctcaagtgatccaccctccttggcctcccaaagtgctgggattacaggcgtgagccaccacgcccgtccaagccacctttcaacagacggccccggtggccgttctcaggtgggactgatctggtcctgctgctgccttcactgagcagcatcgggagaaccaggtggccgctgtccaggctctgcgctcccggccctgctgggtctgctctggagttcagggctcgtgatggtgtcccagtgtgtaggtctgcagaacgaggtggtgcaggaagggtgggccctgggtcccaccgaccaaggctctgggacttccttctccatgttggacgcaggctcaggctggagctctgtgatgcaccggtgccctgctgggggtggacagggagcacagagccccaaggtccaggggcagctctgctctctgtgcccagtgggcccatggcagccttagcggggaggcagggtacagaggggtggcagaggaccctcgccagagcccaaggtccctcgcgcccccaggccttctctggggagaccaggaggcttggaggtcctggggcagctgtgagccctttctgggctggctcttcacatgcacagccttgctctggagcttcccggccatgatctgccttcacagaaaccctggggggccggatgagaaggctccagagaaacgggccgtcgaggagctcgcatccagatgggggtccctcggccgacttggcgaggacacacaaaacacaagagaaatgcccagagggtgtgtcttgtggtccccagcatgggcctggtggacctcagtgagcccttctttgaccctggcgtggtggccgccagtgcctcctcatggctggccctgctcccggtcactgctgggcaccgatgaccccctcattctcccaggcaccccctgagagagactcatgtgagtccaattttcttctttctttgtttttttgagatagggtctcactctgttgtccaggctggactgctatggtgagatcagcgtttaatgctgcctcaacctcctgggctcaagcggtcctcccgcctcagcctctggaatagctggaactacaggtacgtgccaccacactcagataattttttgtttttattttgtagagatgggggcattacattgcccaagctggtcttgaacttctaagctcaagcaatcctcctgcctcggtctctcaaaatgctgggattacaggcatgtgccaccgtgcccggcttagtctgattttctttttttttttgagacagtctcactctgtcgcccaggctggagtgcaatggcgatctcagctcaccacaacttccaccacccaggttcaggtgattcttctgcctcagcctcctgagtagctgggactacaggcacctgccaccacgcctggctaatttttgtatttttagtagagacagggtttcaccatcttggccaggctggtcttgaactcctgacctcatgatctgcctgctttggcctccacagtgctgggataacaggcgtgagccacccctcctggccaagtctgattttcaaatgaggctcagcagggccgggagctacctggtcacccaagggcacaggcagatctgggagaaggtggtttcctgtggggtcccgggacctgttgcagacagagcctctagccctgctcctggggagcctcgctctagatacctggggaagtcgctgagcctcagttcctgggcccctggtccctgacaccccagagcctgcctggcctccgaccctcaagcctcttaccctttcttttcctcaaggctcctctcctgttttctaaaccttctccttcaaaacaaaccctctcaaggctgggtcccagagcaaagatcctcagggttggccaggcgcggtggctcatgcctgtaatcccagcactttgggaggccaaggtgggtagatcacctgaggtcaggagttcaagaccagcctggccaacatggtgaaaccccgtctctactaaaaatacaaaaattagccggggatggtggcacatacctgtaatcccagctactcgggaggctgagcaggagaatcacttaaacccgggaagcggaggttgtggtgagccgagattgtgccactgcactccagtctggtgacagagcgagactctatctgaaaaaaaaaaaaaaaaatcctcagggtgcccgggaacctactggagccagggacagacacatctggatggaaactgcagtgccctatggggtcaggcacatgctagaggcagccaggtcctaggggaagaggaaggagaggtggtgctggcctagggggcaggggtgcgggggacagggctaagccagccatctctgccagaagcaggcagcccttcctgaaatggactttgagagtttgtgatatcataattgacgtcgctgcctgccagagtcaggaaccggcccagagtgtcatccatccccttcactccagcctgactcagaaggtggaattgtgccccccaaatatgtccaagtcctggtgccctcatatctgtgaatgtgaccttatctagaaatagggtcagccgggcgtggtggctcacgcctgtaatcccagcactttgggaggctgagaccggcggatcacctgaggttgggagtctgagaccagctggaccgacatggagaaaccccctctctactaaaaatacaaaaaattagctgggcgtggtggcgcatgcctgtaatcccagctactcgggctgaggcaggagaatcacttgaacccaggaggcagaggttgcggtgagctgagatcacgccattgcactccagcctgggcaacaagagcaaaactccacctcaaaaaaaaaaaaaaaaagaaagaaagaaagaaaaagaaatatggtctttgcagctataatcaagctaagatgaagtcagactggagtagagtgggccctaatccagtgcctggtgtccttctaagagtgagacactgaggacgggcgcggtggatcacacctgtaaatcccagcactttgggaggctgaggcgggcggatcacgaggtcaagagattgagaccatcctggccaacatggtgaaaccccgtctctactaaaaatacaaaaattagctgggcatggtggtgtgcacctgcactcccagttattcagggggctgaggcaggagaatcacttgaaccctgcaggcggagattgcagtgagccgagatcgtgccactgcactccagcctgggtgacagagcaaggctccgtctcaaaaaaaaaaaaaaaaaagacactgagacagtcccaatgccaatgagccgtgcacttaaaaattgttaaaatggtagattatatatataaccacaattcaaaaaataaccagataaaattttaggagcctgaagttatggggcgtgtatacagtgagggaccgcaccgcccgccggcagctttcatctgtcaactcctagtgagaagaacactcacccaccaaaaaaaggaaaaattgaaaatggtgctgatttcgagggtaagtgctagcttgcttgcagggcatttgaatatatgaagtcaaatggacaaattcaaacctgggtcttgttaccaggcaagttactgaaatacttcattcagtttcgcacctgacaatatacaattttagaaagaatatgtatacaaaaaaagagtgaggcagagattggagaccacctgaagctgggacagaggcctcgacaggcctccccgcagagcctccagaaggatccacaccaccgcacgtcggtggccagcttctggcctctcaatccataagaaaagagcttcctgccattgaagcgcccagtctgtggccatctgttgcacagtcaaggacaccaaggcccagacccagctatgtgtgtgtcctggggaggcacagggtgagggggactctctgctcccagggtcggtgcttggggggggtctcccaggagcgggatggggcagggctcctccagtgcaggctgggaggcctcaggggatccacccgccaggaatgcccatgggcccagaaggcacagggtgggggttccctaaactctctggaggctggggctgggggaacaggctgttccagcaaggggccctgaggctgtggccacacacgggctgggagggatccggcctgtgcctgggcacttagcctgagtgtgggggggaccagggcctgtgcaggtcacgtggcctccacggtgtcagctccaagggacactgctcggcctcctcttagtcaacccagggacgactccttcctggtgggacctcccttcttgaggcttccaggaggcactcctgtgtctctggtctccgcttcccggcccctcctccctcctgaagctccatcctgtccccagcgtccctgagatgacctcacccacgccagtttcccattccatgctctgcggcaggctccggagtccacatctccaagccgagtaggcgtccctcacatgctcctgctcgaaccggccgcctgacctccttgagcccagcagatggccacgcagagccctgagttgcagtggaacctgctggccctctggcacccatctcattgaggggcccccccaccccaggagtacaggcctgtggctgtgttcctatgtggctttgctccccacacccacaagaacacgcacaacagatcctgggcgtcttcaaaattcaggcaatgtccagctcgggccttcccagccactcggctccctccccaacccagcacctcctccctggccctgcatcccctccacttggacctcctctggttccctccctgcaagcagcccaggctccaagccctccacgggccccccaaggcacagtcccagagccaaagtcttcccctcggccttccaggacctctggaatccagccactggctcgaaccctctgaccccatctctcctcccctccccatttcctgcccccactgaaggcccagtggcctcctttccttcctggaagccccagggcctttgtacctgacagtctcccagtcagaaatgccccccagtcagggcgcggtggctcacacctgtaatcccagcactttgggaggctgaagtaggtggatcacgaggtcaggagatagagaccatcctggctaacacggtgaaaccccgtctctaataaaaatgcaaaaattagctgggcgtggtggctggcgcctgtaatcccagctactcaggaagctgaggcaggagaattgcctgaacctgggaggcggaggttgcagtgagccgagattgcgccactgcactccagcctgggcaacagagagagactccgtctcaaaaaaaaaaaaaagaaaagaaaagaaaaagaaatgcccccagctgtatgcctcctcctcgcccgcagtactgtactccaaggtcaccttggctgccccgttgaacactgcagcccctcgagccgctatgcgcaccctcaacaacgcaggcgccagcgcttggcgtgtcccagctcctgtgcacccatgctggccctgtgtgcccatgtggtgactgaaccaggcggccagctgacccatggggtgccccttccctgagagctgcttccttcctcatccacagggtacttggagactggccccgggctgggcccctgtctggagcgccgaggcctgcctgtcggcctgggatgactgcagaggctgctgtcaaggaagctgtgctccatggtcaggacaagcaagccgacctaggggcccaagagaccaagatgagctctccaggccccacagcccggccctgagcctcctctgctgaagccagcccgtgcgctgacagcggtatggggcctgcatgattggcgcaggaataagcaaagagaccctggacccaagggcgggtccagaaagcggccccttccccacgccgatttataacaaaggcccctgcagagcagggggaagaggtggcctttccctgccacgtgtccagtatcagttggacactgacagaaaaaagtgaccccatccccacaattaatttaaaatgagtcacagagcaggctgggcacggtggctcacacctgtaatcccagcactttgggaggctgaggcgggcggatcacttcaggccaggagttcaagaccagcctggccaacatggtgacaccctgtctctactaaaaatacataacttagccgggcgtggtggcacactcctgtaatcccagctactcgggaggctgaagcacaagaattgtttgaacccaggaggcagagggtgcagtgagctgaaattgcaccaccgcactccagcctgggtgacagagggagactctgtctcaaaaaataatactaataaatgaaataagtcatagaacaaagtgtgaaaaataagccccaaagcttctagaataaaacatagcaaaatctcttcaagacactgtggtcaggccaggcacagtggctcacacctgtcatcccagcactttgggaggccgaggtgggcggatcacctgaggtcaggagtttgagaccagcctggccaacatggtgaaaccctgtctctactaaaaatataaaaattagctgggtatggtggcgcatgcctgtaatcccagctactcgggaggctgaggcaggagaatcacctgaacctgggaggcggaggttgcagtgagctgaaatggcgccactgcactccagcctgggcgacaaagcgagactccgtctcaaaagaaaaagaagaagacactgtggtcagcaaagatttctaacatagaacacaaagggactcgacataaaagactgggcttccttaaaatcaacaactttgagacaccatcaagagagtcaaaaggtaagttgcagacaaatgtaccgttcgcctcggtgtgtcttaatagattctacaccaaggccttctgcccagaatatatcaagaactcctacaaattgataagaaaaagataaacaaaccaatttttaaaatgggcaatacacttgaacaagtacttcacagacctgaagtgcattgaaagggctaaatgcagtgaaaaactggtcagcctcattagtcaccagcgaaataagcatttaaaccataatgagatgccacttcatgccttcacaaaggctaaaactacagaatgacttttctttatttattttttctttttttggagacagagtctcattctgttgcccaggctggagtgcagtggcgcgatctcggctcgctgcaaactctgcctcctgggttcaaacgattctcctgcctcagcccccaagtagctggaattacaggcacgcaccaccacgcctggctaatttttgcatttttaatagagacggggtttaaccatgttggccaggctggtcttgaactcttgatctcaggtaatccacccactatggcctcccaaagtgctggggttacaggtttgagcctctgtgcccggcccggccaaagactgcctattctaaacgttgctgaggacgtggaacaatcacagctctcctctctttccagtgggagtttaacatggcacaaccgcctgaaaaccgtttggtgatttctgtgaattcctatgccttctctatgacccagcaattccactcctggatggagttaacctgtgatggttaattttctgtgtcaacttgtctggggcacggggtgcccagatatttggtcagcataatttgggctatttctttgagggtgtttctgcatgagatgacccggtgctctgagtgacgctgactgccctccccagtgtggtctggccccatgcactcagctgaggaaatactaggatagaataagaagtcccaggagtcagagggccagctctcccagggtctcaagcctgccagctttcagcctggagtggtggtatcaccctcaggggtctccagggtgccaaccgtggctctcgggacttgtcagcctccatcatcacaggagcagattccttctcatcgatctttttctccagatacagagatgggtgtgtcccctgctggctctggttctttggagaccccggctaacacacacctgagacggagaagggcttctgtgaccaagggacacaaacaggaacctgccgagcagagttcctcatcacagcccttgtgtgtttctttagggatgccgtaacaaagttccccagtcaggtggcctaaagcaacaccattgcattctctcacagtctgtaaagccaaggcctggaatcaaggcgtgggcaggattggctccttctgaaggctctgagggaaaatccttccggcacctctccccagcttctggggacagcagcaatgccccccgggtatctgtgtctagtctccctccacctcgctcttctaaggacacctgtcgttggatttaggacccacccaactccaagataatctttgtaaatgtcattaattaatttgtaaatgtcacctgagaccaagagttcacgaccagcctggccaacatggtaaaaccccgtctctactaaaaatgcaaaaattagcctggcatggtggtgcatgcctgtagttccagctacttgggagcctgaggcaggagaatcgtttgaacccaggaggcagagtttgcagtgtgctgagatcgcgccactgcactccagcctgggcaacagagtgagactctgtctccaaaaaaagaataaataaataaataacagtctgtaattaaatgtcattaattaatgacatttacaaagattatttttccgaagaagttccctttcataggatctgggtggacacatattttgggtgccaccattcaacaagccccaaaccagaaataacccaaatgtccatcagtgggaggctgggtcagcgtgcgtggtttattcctacaacggaatataattcagcaacaaagaggagccactgatgcacgtggcaactcggatgaatctcccaggcatgacgccgaactcaagcagcaagataggaccaaggcctgaggaaggcgaagctgccaggtgggcctcagcagcggaccctggtcagggcttggagtgccggttgaagacccaagggctgcacgagaatctcatgggtgagaacgcgttgagctgcagcccaaagatgggagcatttatttatttatttatttatttttgagatggagtcttgctctgtcacccaggctggagtgcagtggcacaatctcggctcactgcaacctccgcctcctgggttcaagcaattctcctgcctcagcctcctgactagctgggattacgggcatgtgccaccacggccagctaatttttttcaccatattggccaggctggtcttgaactcctgaccttgtgatctgcccgccttggcctcccaaagtactggattaccggcatgagccactgcgccagtaagtggctgatgggagcattttaccgcctggatgttgtaccttgactgaaaagggaaccccaaccaagccctgaagctggggcgggtgcaatttgagtttggggagggtgggagcaggtgctggtggggctgggggagttgggggggctgggggagtcgggggatctgggagagtcggtggggctgggggattccgggggcgctgggggagtcaggcactcactccacatctctaagcatcagtttctccatctgtcaaatgggcgagtgagccccgcctcagataccgcagagagtgccaagccaggcaacttctggggggcttaacgagcgttcgtcttagtccatctgccccgtgggcagagcccactccacagggagggagccaggctggcctcgtggcaggaggctggaagcagcacttgcaggtgtgtgcatgagcaggccagtgtgtgctgacgcacgtgtgtgttcacatgagcacatgcataaatatctcaggtgaaattaacatcgggaagagtccaccagaaatgaaataatgcacatggactggctcagtatttttttttttttcagatggagttttgttcttgttgcccaggctggagtgcaatggtgtggtctcggctcaccgcagcctctgcctccctggttcaagtgattctcctgcctcggccacccaagtagctgggattacaggtgcccgcaataacatccagctaattttttgtatttttagtagagatggggtttctccatgttggtcaggctggtctcaaactcctgacctcaggtgatccgcccacctcggcctcccaaagtactgggattacaggcatgatccaccacgccgggccctggtctttttttttttttttttaagagagagtttgctctgtcacccaggctggagtgtaggtggcacgatctcggctcactgcagcctccacttcccaggttcaagcaattctcccacctcagcctcccgagtagctgggattacaggcgcccaccaccatgcctgactaatttttgtatttcagggtttcaccatgttggccaggctgatctcgaactcctgacctcaggtgatccacctgcctcggcctcccaaagtactaggattacaagtgtgagccaccgtgccctgccaagactgttttgatgtcagaaaaaatactgaatgccacaatctgggctcatggtgtgtgggcggctacacatcagggttcagcatgtatgttgaggggtctgccttggcccctctattcctgggcccaagcagatggggtagcaggtggggaggggtctcagttgtctgggtgggctttctggcccaccccactctccccctcacccaggatggggcgtcctgctgggtcagggagtctcagggctcccaggcagtctgaacgctggaacttgggcatcactgcactgggtcccctccccagggtgcagcaggccctacatcatagggcacacccaccctacctccccttcaatcccactcagtcaggccaggccctgcccaggccccttggggctgcagtttctcagggaacagcactgcccagagcgcctcccctacggcagccactgcccaccccgccctaggcatccctctctgcggccccgcaggggcatgagagtggcagcatggcggcaggctccctgtgcagtgtgcttcctgccagggaactcgtcagcctcctgctggtgtcacacatccctgaccctccctcagggtcctcccaggtttcccaggcccggggcagggggcagagcagcaggagacaggagtggtgatccaccaggcaaggggctgggctggtgaaggcatcctctgggatccctggccaggctggggccaggaatgggagaggctcggggggatgctggggcagagcccaggagctggaggggaagcaggcggggagagagcagagccccgctgaagggagccacagtgagccctgggcacaggtgggacaggcctcgagtcctccttggccaggagactcccaggaaggatggcacgaaggcaggggtgggccgccaggagcctgcggagcccgtccacatctgccaggcaccgcctgtacgacaggccagctcccagcgtggttgaggtcccaggtccctccggcgcccagcaatgcccgggtcccagacaggacaagttcctgcctccctcttaccagcaggacctgccgggcatctgagctgcctggggtgtcacaggtgagccagcagtggcgggtgggaagtgacgtgtcatgggtgaacagcagtggagggtggagctgttgagccagtcctgggcggcgtatggctggataggaggtgtcccaggccacacttcgaaaaggacaaatggactaggtcgctgccctggacccataacatgcacctggctgtgccccccgctccccccacaccccgctccctacccctccaccccctgctcccccccactccccacacccacacccctccgctccccccccgcctcccctcacatcctccccactagcccccatccccctggctcccccccccgctccccccacccccaccgctgcctcccatcctcccgctccactcccccgctccccccactctcccatcccccccgctctccccccactcccactactccccacccccactccccacccgccctgccccaggcaagcctcaggggtggtggctgttgactgcaggagcagagccagaacagctggcggagaccaaacctggtcatccttcacaggctgtgtggccatgggcaagtcactctacctctctgggtcccggtctccacattttcagagtgagggcagtttctctgtgccctgaaagtggctgggagtctaggccaggtgacagctcagggcaagttctcaagggccccagaagcatctggggtgcaggggaggttccaggatccccagttcccacctttaaatgaggtgactcgagaccctctgagatgaagggaccctgaacgttgatcattttgacctcccatctctaggagcatgtccagagtctgccattccttccagaaaggaaaaaggagaactcacatcaagatctcccttgtttagccagggaggtgggagtggggccggggggcagccaggaaacatgagcacgttcgtcatggagggcaggggctgcacgggcggccaggcagtgtgagcccatggtcagcaccagcggcgagctgtcatctccctgtgcctcagttcccttccctgtaaaacagaactctgcaccgcccccgaccccatgccaaggtgctgggcaaagctgcaaaggtgctggtgcccggccaccctcagtcaaggcggcaagaacccctcggtgagtggacgtggccccacagggatgtagaggatgaggcagaacccagggctccccgagttccaagtccacgctcccctgcacacgggcccaccgccgccctttccagagagaaaaagaaatttctgtctaaagtcagtcagaacacccccagactccacactggtgacgtccgaatccccccggacaccggtgtggcctcagtccttcctcccagctggttcgctcagctcttgctccctgccagcccccaggtcctggtccttctgccacaggctagcaggcaccccacagcccgatggcggctcagatggagactgcggtactggatatcctgggggtaacatcacagccacaccctccgccaggctggggacagctgcccatgggccgggccaggccagtgctgggattatgtctggggccacccaacaaaagaccacaaatggggcagctgcaaacaacagaagtctattttctccgagtcctggtggccggaaccaaaatcaagctatcggcaggactgtcctctctctgcaggctgcaggggaggttcttcccgcctcttctggcatttggtggccccaggtgtcccgtggacgtggccgtgtcattcccatctctgcctcatcttcacgtggcctctgtcgcctccctctcaaatctcccccgacctctgtcttctaagggcctttgtctctggacaaagacccttttcccaaataagcctgtcgtgttcacaggctccaggtggaccgatcatttgggggccaccactgtgcccactgcagtggagtcggggacggggccactcatggccatgaggccacaaacgggtgtggggtctgagagcagcaggcaggtcacccaacaccagacaggagcaagcccaagcaggggtggccgagagagccgggagggtgatcgggtgaaacgcctgccctcagaggaagagacgggacatggcccacggcggggtctcacctgcggcctctggttctccccgtgctttggcgccgctcccgctccatcctgtcccttcactcccctgttggagagggttttcccacaatggcctggacatggagggctcgggaggtgggtgaccttcccagtgtgcccagctggaactggtcgacttgggcccaggtccatgtgagtcccgggccccgctgcctcctgagaccaaggagcatttccctctctggcgatgggcacgggagctcctggcaggacggcgaccgtccggtgggcccggagaggaggcagctgctgcaccctcggcgctggctctcagggatggctgggctgttaggcccgaactagacctgctgccgccgtgtggagaagaggtggccccaggagcccactgtctcgggtgtgggccatctccatgcctgttcctgtccccatcacacaccaggcagtccccaccagcgcccacatcctcaccagggctctccacgtcccctcctctggtccccacccatgtgtcagctcctcacagttccaaggggccacccagcatccccggggcccaagcccttagaggatgtggtctgggagggtgggacagacacttcttccccaagtctgcctctgatgtgtcacccaaacctttaaactttgcacctcagttttatttatttatttatttttattttttttgagacagactcgctctgtcgcccaggctgcaggctgtggggtgtggcgtgatctcagctcactgcaacctccgcctcccaggttcaagcgattctcctgcctcagcctcctgagtagctgggattacaggtgtgcggcaccacatccagctaatttttgtatttttagtagagatggggtttcaccacgttggccaggctggcctcgaactcctgacctcaggtcatacacccgccttagcctcccaaagtgctgggattacaggcatgagccaatgcacctggtgggacctcaggtctataatgatctaaatcacccaacaggaggaggcagcaagacctggcagcgagggccaagcaggaaggccatctgcctgccccctgcctgtcccctccccacccccagctctcccaggcactacagcctggggcagcccctcccccagggccccaccctcagcctcctgtgcaggtgagcaggagcgggcagcctcactggagcccagatgacggagccggagcccctgccccaccccacctgcatttgaggggtgggatctgcttctggccatgagggaggacagacccccacactctacaaagcctgccccttggctgcttggctgtctgggccaattctggttgtcctgaaccagaggccaccaacgggccccgtggaggctcagaaccaaaatcccacattctcagaggttcttggggtcctcagggttgggtagtgcagcagcgtgcaggctgggagggaagcctgggatcaaatcctggctccccttcttcccgtttggtggccttgacggagagtgagggcttcctggtgactgagcctcgctttcctcgtgtgtcctgggctcggagaagtcctttctggaggaaggagggtcccttcctcttggtcagggcgggaagaaatgtgccccaaggagggatggcagcgcccactgcgcccctttcctcctccccccaccccgggctcctcctctgattccgttttggggactctttcctgcccctcagagtctgaggcttctaggcctgcgctgttcataccttgaccccaccccagcccccatgttcgcaagcctgtgtcccctggagcctcttgtcacagaggaccctctcctgtggagtcccagggctccactcgcccccatggggtttccagcttgcagcctggggtcctgggacgggtgcagggaggcaagtggcccccagcccacggagccccatcatgcagaaaattcggcaaaacccagcttcctccgagtgaggcggctgtcccagggcaagctcggggagggcactgttgccccgctgtcccttggccacggcagggttaggctgtagcatgggcaagactcagggacacagaaatcggaaggggagtctaaaagggggtccagccctgcccagcagcctcaccacctggtggcatcacccccacgctgggcgagctgccccctctccagggcagggctccaaaccgctctgggggaagctggcctcagctgggtgtcggggggcctgggcccatttgcctggacgctgcgggcaccctgcccctctggctccccggggtcctgggcctctcgcgggcaggaatgccatctgtgccatctgaccagggctcccctcactgtgcaccctggcgttttggggcgtgggaaggcgttcaaggctggtttctgtttccccgtcaagccctgagtggagtgcgaccggaggctggccagtggctccccgggcacctaggggaggctgggggcaaactgaggcagtctagagcctacaatcactccaggggcctgtggggcagggacagggctgaggggacctggcaccctgtgggttccccagcagtgtggctggggacatggggacagagcccaccttgcagcctctgatctctgggcctggacatttgtttggagtagtgttcactggtttgttttgttttcttttttttgagacagagtctctctctgttgcccaggctggagtgcagtggcgcgatctcagctcactgcaagctccgcctcctgggttcgagcgattctcgtgcctcagcctcccaagtagctggggctacaggtgcccaccaccacgcctggctaatttttgtattcttagtagagacggggtttcaccaagttggccaggctggtcttggactcctggcctcaggtgatccacccgcctcagcctcccaaagtgctgggattacaggtgtgaaccaccacgcctggcctgttttgttttctgattgcaaaatgaatacatttcaaaagggaaatttgaaaaatataaaaaatccttaaaaagagaataaaacccacccatcaacccatcatgctatacccaggaacactacctccagcttccaggacccccaacctcagccaagggtctccacatacttctctcttctgtaattgggtcttcccgcggaggctggggcctgggcggatggatgcccagggtgggggctacctcctctggactgccgagacctccccagcaatgaggtgccagaccaggaccggggtgaactcaccatgagcttctgttgccgtctgggcctgggctgggagcaggaatctctggggaaggccaagcatgtttcagagtcatcgggatcagggccaccctctccctcccccagtgtctgcagccattttcataggaaaaaaactgggtttaacaaagctgttccagacctcctgacctgaaactgatttctacccttccgtgtggccctaaggctcccaggcacgaggcgcatagctaggggaagacagtgcctctgacacccatttaagagttaactgaggccaaaaagccgctctgcacgcccctcttgttcagaggcccactgatcccctggtcccgtggtcaccacggggtatgggtgcagacaaagccgtgttcatggaagctccgggcctgatgacagtggcacaaggaccccattctctgctgtctccagctgcatcccctcccccagccggcctgacatcagagacagcgggtcagacatcccgggatcccccactcccaccccagggcgcaggctcagctgctggggctcagggaaatgcacaagagggcctgtgctggggagacagggcgtggatgaactgcctgagtggtgcagacagctgcagcttggcccagcaagtcttcagtgggaagctgcctgcatttttacaactgatttttgaacctgaaagtggaggttcacatccagcctgttcaacgtaatcttgttggttccagtccaacgtgaccttttggaatctggtttccagactcttgccatatattagcagttcctcccggctgcaggctgcgatctgccttgctggggcctcatcccagagaaacaggctggccgggagcattcggaggggcttcccaggaagagctggaccctgacacatctttccgtgggtgctgtggccaagacgcccaatggctggtcatgaggcccattttgttctgctcctggtctacaaggcagaagtcgggacgcatcatgtctgccccagccaggagtcttagggttgtcccaggcccaaaagtcagccaaccctagtactagttttccagaagaatccagagcctacgcacccaggccctcagtgtgaacaagggcacgttatttgctctcacagtctccttctgctcatctgtaaaatgggcatggccaccatgccctctgtgtcccaggctgtctagagggttgagcaggcagggtaggatctggtacccaccatgcccccgatgcccacgcaggccagagaggggagaaatggagttggctgaggcctggccctccaatgccctctctgggctctgaaccagggctccgtccgtcccctggggctgcctcccgcaggccagggctcctttatcctccccgttgagcacctggggcgcggggatgacagcctcatttccccaagcagcccccacagggctccctggattcctctctgacaagcacatgcgccggctctggtcttggctccgtgtgccccagcacgacagaacaagtgcggcaagacccaggcctgcagggcggcggcaagtgcccggaggggcggaggcgggggtagggggtatgccggcgcccggcagtgtcgctgtccccgcgccaccgaccccaccccggcgtgaccttccctgccgcgcgcccaaaggccagcaaagcaggcggcgcttttaaggacgcggcggcgcggcgggttcggtgccaggaggcgccggggggcggagggagggggcgctcgaggccagaggagcgacccccggcagccacccaggcgcgccccgctcgtcactcgctctcttctcccacttgcgccggccgggggcggggcgcggcggcgagggtgggggctgggcagccggggtcctccctcccccgctgtgctggaggcagcggggcgctccccggagctggggcgcggagggagggccgagggcgcgtcggagcctcatccggcctgggccctccgagcgggagcgacccgggtgcggggccccactctgcctggtcgccccgagcgcgtggaacgcgagccgaggttccgcccgaaatgcggccggcgaaggggtgcggtccgggcggggtcgcgcgcccccagcacgctgcctgggctctggaatctgggagaagcctccagcacgggctcccgagcgcacaaactcagggacgcccttcctcccgtccctggtcccctccccgaaaagcgagggggacgggcctggagggaaacggattcggtttcgctccgctctcgtcaattttctgtttaatgtcaccgggccccactgtgggagtaggaagcgcgtcacccgggccataaatttgcggtgatggcgcctccggccgcctccccagacggagggacagggccgactccggagcaggtggggccgccgagactcgacctccgcggtaggcgctgcgcggcttctcccgacgcgggtcccgggcgcgctcggccgcccctcccgccgcatccgcccgcgcccggccccgccgcgggatttccaaagggcttttgttccgggcttggatgtagaggctttgatttttttaccacccgcctcaggagactttttgcttggaaaagtcctgctattaaaacaaaaacaaaaaccaatcaattccggagggaagaaaatgcctccagtgtgtgtctgcgcttcccccgggccgaggacggtggtcggggctgcgtattgcccggaccccgggtaggggaggcgcagagacccggccctaatggacttcgctcggaaaggccccggcggaagtggccgggagagcgggcggctgcgtgggtctgggccctggcccggggcaggctcctctggcctgcctgccttggctgcttggaaagggatttctggggagtctccctttgggggcactttccccgaaactcctctcccgcctggggaattacccctgcagcgggtactgatgcttcatgaattgagatggaatacgtatttgttcaggccagaaaaaaaaaatgaatctattgaatgatttttaatttaatggatcaactgtcctgttaacaaaagaggcggtggccgtgtttggcgccaggcgggaggcagcagtcaggtggtccaggggctggaggtgagggctttgccgcaggcgcatgctgctctgtgagaactccgaggaataactcactggagggctataaatgctgaaggtaaccaggccaaggactccagtgcccccagaagtcgcaggggagagacagtctgtcccctctggtccagcccagggagggcctgcagcctccccatgggagccatggccaagggggagaaaggtctccagggctggagggcaggtgggcggtggggctcatctcaggggcagggcgtgggggtttgtgggccaggacccacccaagggctgggtctgggaggtgcttggggagcccagggcgacctggtgtgtgccctgcgggatgccccgagggctcctgcttgtgttgccagcacctgcccttgggagccgtcagctggggccacgatgctggcagggtgaggcctggcagggtctggggcttttggagggtgggggctaagggaacccctggtggaagctgccttcagggttcctgcctgccttgaggatgggtgataaggggctgggccctgccctcctgctgcctgggctctgtaactgatgctcagaggaccgggtggagttgggtgggagacctaaatgctccacggtcctgtaggtctcagctggcctggccccgccacccagcccacacccttcccctagggccctctcaccagtgtgagaataggcctggggaagtctgggcccgggaggcccccgacccccactgtccagacaccctgacagcgacacgtgtaaacaccgccaaacagtggagacaggcagccctgccgcccctccgcctctgcagccaggcctggtctggcagggagtggaggcaggtgtccttgcagggagggcccgaagccaggctctgccttggaggatgctccggaaggaccacataagcagtgccctcgtttggattggtcctgcctgagcattgtccccaagcagggcagtttcagccactaggccctcccaacccccatctgtctgatctgggctttctctcccgggtctggcttcctgtcctcatcctcatgggcaggaagacggagggctgtttcgggtcaacctcctgtaaggaaaaccgattactctttattccagcagatccccaaagcgcatcccttggcccagagattcccagagaaccctgcccctccaggtccacccccagactggctgcctggggggaaggagccggcctttagggaaggcagcctggcatggtggaggttccctgggctcctgggcctttctccagccctccagccgcagaggtgacagtgaccagggggctggaggggcagcaggacaatggtgagtggaggggggctgggaggctccctcctcagcctgggggtccctggcaactcccaccttccttgatcccctctaataattgcaacaataacactgtcactaataaaaaggcaggggaaaccaggcaaaggggcgcttctgccctttatgaaaatcactttaatttaacccagatgggtcttgttgataacctcatacaatgagcaccctgaattatactttccgtgagaacacactagttatatttagccacaaattacgactctgtgtttaacaagcaactttgagagtggggagggggccgggcagcctcctgacctggttggacaaaaccggcaactgcagcaatggagaccccctcgctggaggggacgccgagaaagccgtgccacgggcttctgagtctctcttctctgctgctctagtttctttaaaacacttacaacctcgtccgaggtctgtcgaggagactgtggccttcaggtacaacctgagcctcccccaggatccctgggacttctgccttcccacacccccaacctggctccctgcttgggctggagccggggaccttctgggagagcccagttcgacaggctggggggctgggggccgtgtgtgcctggaggacaatcctcctacccaggtctggcccctgacaagtcttgctcctctgtggcctgcctcagcccccttaccctgggcctcagcccaggcctggtcgggagggggcaggcgctggggacgagggtgagggcactccctccatgcagccccctcccctgccacctcatcccctgggtcctgataaataatgaaggggctgtgactggaagcttcgttttcagtgggggcagcccccttcccttcggaaccttcgccgtcctcttcccctccacaacagttctgctcctaggaagggtaagcctccaaaggcagaagctgtggcagagaaaaggctgtccccccactccaaggcacggaccctggggcttcccgatcctccccagagccagaggccacaccgctgagcaggggaggtgaggggggaacacacagacctttcccccacaccctgttccctccaggcaccaggcaaggccctcatgaaaagaactcgccccagtcgatagcagagggacccgtacaggcagatgggtggggtggggggtcaggacctcttccaggagggagtgggattgttcctaaccccctgcccccagctgtcctctggaacactgattctggggtgggggtgagctgctgctgccctccagttgagggaggtctctgtgctgtgaaccatcttagatcccccacctctaccccacctctaccccgcctacccctcctgccgccagccccagcctcaggcctggcctctggacttgtccccctgcgcctctggtgggaagaattaagagtcaatttttgtcgtcaagaaattgtttctaatttgccctttgactaatggcccagggaacaatggagagatacccaacacacgattattgggggcgcagcgggcgcagcgcggctgctctcgggccgaagcaggcatttatttggagcagcggctaattcacaatttcatggaacttgcctgacacccccacccccttgtattaaaaaatgattatttatatgatgatttcagacagagcagcatctcagaggtttgggagccgggagacctacatctgctgctcttggggagcgtgggggtgggagaggagtgctggagggggctccagggctgggcccggttgtgggggaacaggggcccctaggctgaaagggagaaggcagttctcgggagtgcttctgcgtgtgtgatatgcctctgcacacatgtcttgtgcatgtgggagtgtcacatgctgcacgaggctcacctgtctgcccatctgtgctgtgggtttggttttgtgtacacttccaagtgattcacatgtgggcacatgagtgtgtgcaggcagatgtgtgggcacacattcaagactgtgcacaagtgtgtgtgtgaatatagtgtgcgttaaagggtgatgtgagccggcctgctaggtgtaggagcgcagctggttatgtggggcggggggttatctgctccccaggccagagggcaaatctggagtggtgtatgccaggcccatggaagtgactccagatcctgctggagagggatcaaggtggggttcaaggccactcctggcactgttccaggccccactgggtgtccacaggcctagcctcacttgcagcccgctcacctgcaaagctgcaggaacttcagagacctgggccctccagcatcaacactgacctcgggtctattatcccctctcctttcctccccctctgtcccctcgctggccctctccccagtggaaggcaagtctgcagatccccacaccatgttcctctgaaattaaaaacatttgttagctctggacagcaggaagagtaaaaaaggaaagtagggaggtttcctctgagcagatcgccagcctgagctcccggcggcccaagtcttccaggggaactcgggagcttattttggtattgcgggagctgcccagcggccaggcgcctgtgctgggcagctgccagcccctctccaccgcgtccagcagacccgtctgcagttatttgctgtaacaactgttttgaaacagtattgaaaaaaaaaaagcccactagaatttgcttcaagtgaacactgggggaggaggaggcagaagtggggaggaaggaggagggcagggagcttccgcactgccctggaaggcgcactcgacgcctcggggcctttgcccacgcgagcagcctctttcggggacacgaagggaccagcacttgggggatttgaagccagtgctcatcctaggaatctggtgaggctgagccagaagggtctaaaccagcttgaggagataggggccacgcacccgcgagctaccctctgccctcccatgtccctggcagtgggcatttctcaaatggtgattgatgactggggatgggggtgggcaagccgagggcccatcattcaggctccaggaccctcgaacaatctgcccacgggggaggggaggctggtttaggggctctgaggggcctttccagcggctgtccttccaacacactctagaggagaccaggactcccaggggcttggggcctcccgttcccccacagggcggttagaggtggagcacctgccctgatgcgaggagctcagagcaacttctgggacaccacgggtggccacggtgttctttttgttgcatccaagatttttctcgtatacgtattttcctatattaaaaaattcaaatgaggctttaaaaattaacttgaaaaaggttcctgatccggaaacaggctcatcggaggcagtgatgggaactcggttccttaggagagtaggaaatgcgccgtctgcgaggggcgccctgcgtggacccggggcctcggggcgcgtccacttacccgagccaggagagactgggccccacggtgttagccccgcgctcgggctcgcgcgccgcttccagctcgcgcctcctccatccccggagggctccgcgggtccccggcgacgggtccctgcccagggtccgggaaccttcccctcccctcctttctcaagcgccatttctccggagccgggccggccgtcctcggtgtacgcgggaagcgggcagcctccgcctgcacccgcggggccgggacccggaggcacccgcttccccgacacactcgctggggccgctgctcgctgctccagcctcccgaggccacggcaagagcccgggggtcggcgccacacacccccagccggcgaccgcgcccagggacctaattcaatcgcccccagcctaatgaatagccgcgcgctaatcggatctccgcgcgcttcggggatttacgcttcccggctctccccctcgtgccccgcggcccgccagacgtcgcttccgaaggcgccggcctggggcctggccaggggctcggccgcggggggtcccggccgccggagccgggagacgccggagacgggagccgggcccgcgcgaccgccactcccgagccagccggggtgggccccgcgccttgtcctgcgtccccggcccggcccgcggagcgccggtgcttacctgcgagccccgggctctccggagctcccctccgggccgagccgcccgaagcgggcgccggcgtaggccccgactcaggcaggcgggaaatcccggagtccccgcccgcggcccgcagccccccaccccaggtcggcgtggcctgcgggggggaaggccggccggggccggccgcccgcttcccctttctctccagattcctttgatccgcgggctctccgccgcacctcggctcccgggctgccccggtcggcccgcggggatcctggaaacggtccccagcttatctcctttcatcaagcggccttgggccgccttgaaaccgcggagccagtaattgcttttttcaggaggcccagtgcggactggacaacagccaatcagcgccttgtttacactcggtgatggacagtccactggcggagtgccaaccaatcccagcggtcccgcgggagcgggagtgggggcggggaaacagagagacaacaggctttgagtttaactctttcgtgtccctgccggaatgagacggtggagaatttcgaatgcgtgtgaatctgtcagttggctcctagtttaaatatccttttttcccccagagggggaggcagagattcacatggagaaagaggagcaaaaataaatgtatccatcgccactaagacatcacctcgactccctgagaataaatagcatttgggtgggaaaccaaattctaacagaaatatttgtttgcggaatattttagaagtggtttgcatctgattacgataaaaattgttcagtggcttgctttagttggagtgaggatttagcagataggcagacagggagcagcattgagaaatactatacatggtttaccacaccatacccgcttcccccattaccaaactgaaaatattttctaaatctaggtgtagatgaagaaagggcaatccttgtcttctcaataaatccctgattttcattttagtagctgctctgttgcaaagtgtggcagagggagataaaattgagagccagtaatgtagacggctggagactcagaactcacttcccagggtctgatccccaggtcatggggaggagagagccggacgggctattcaaagcttttgctgcccaagcagcgggcgtgcgtgcgtgcatccgcgagctcgggtccgggcaggcagcagcttcagagcggtagatgggccaggcaacctggggaggcctctgggcttggaggtctggcctacctgccacctgccagacagattccagggagaaaaagcagctacttttaaggggtggtggtgtttcttcccttggccttctgtgcggcagaagccaaacgttagacctgctggattaaacatatatgtgtgtgtgtgtgtctgtgtctgtgtctacgcctccccctccgccgggacacgcgcactcgctcgctccagctccctctcccgccctgcgccaccacattcccattcagcagcaatgatctgcgcagaggagctgcgcagtcgccgggcttgaattaggcgccatcgggcttggtagtagccccgctgcttcctgattggcagttccctggcccggcgccagcctattgggaggcctgtttacgccgaatgagtggcacgagctcccggccgtggagggctgcgcggccaatcagcgcgctggctgttccgggctgagtggcacgagcttattagtatgcagggcccgtggctcgccgcgccaggctgcaggtttgagagccgctctggatgggctcgctagagtcgttgttgtggaagcggtgcatttacagtgcaacagtcagcacattgaaaataccaataggaatacaaaacaaagtcacatttactgatttaattgtattgcattcagttgtatccaggaaacagcctccagtaagtaactgaaattgctttcattttttttttgtttttgtatttttattattattttattttttattctggctttggggttttacattttttttagcaaaagaaattcaggattgtgatgttaagaagtatatatcttcccttttaacaaaatccgttaaaatgttgaggcttttttttttcttaaaaaatatggactatgagcgatttttttttctctgaaaaatcttatcgatcggtttaaaattacccccgtaatgcatccttgctttgctctgagcgcttgttgtctcgatcgacacccagcattaaaaacaaatactcgaagacaggacagggaccgccaggctgcgtctggcgcgagccgcgcgggtggcaccgggcggacagtaggcgaagtccgggcgccgccagcgtgcgcccagttctgggtgacccacgaacgaaccccaacattcgctcccctaccctgctcccctccccggaacagtcctgggttggccctgcccggtcggtccgcggcgaggggaactggccgggtcgtggtacccacggccgctgccctgaggggccttccgggccgaagctaggggccggggaggggaatggtcatggcgagtttttcgggtcttcgttcccaattcagaattttttttttccggagaagtgggggtggaggagggggaccgagcaaggccggcgcagcggggcgttttcaccgcgcgcgttcgggacggcgcgcggggctcgggtcacggcccgtgtggcggggtccgcgggctggttttcttcgggcgcgggggtcaggcgcgaccccagttctcatgactctcccagggagcgggtgcggctgtttcgcagggagcgggttctgcggcgacggccgagccactcgcgccccaaggcgcgcctggtcccagcccggcctgcaggccccaccgcgcccgcgctcccggagacgacgccggagggaggcagacgggccagagtcctggtctccggcaggcgggcgaggagagagcgggtttttagatgcaaaagcaggaaacaaagcaaacttgtagaagctccagatcctggagcgcgccagccacgcctggggccgcggcaagagggaccggcggctccagggtcacgccctgccttcccgggagggagccctgtgctcctaggttcagttccttccgaaatgccctcgtcagcgattctccgcccgcccggggccctctgcccgccgccacttttcgctccatttcctcccttacctcagcccgacctggcgctgcggcgccgtcctcgcggtcctccggcgcggcctctcctggagctgggctgggagtgggccccgggcctcggcactcggcgggtggcggcgtcgccgctgcgggactgtgggactcccagctcgggccgtgtggccgcccttcctcgccccacttcctggccgcctcaggctccccaggcccccgaagcccggcgcgggcagacgcggaggcgcggcgcggcctctccccgggaggagagaacacaaagaaaagctctctccaatccggtcagagccgtggcggcgcaggcaggcgacagtaatccacctcctgtttgcttaaaaagtcgagcaggctggtgagaaaggaacaatcgggcctgcgatccgcccgcagggggtgggagattaaaattgttgcttcgtagccgagcccgcgtcccgagaatcgccggcagctcgcgctttctcaactttgaaatttcttattggagagaaaaaaaaaaaaaaaaacaaccacaaaacaaaagcacagcacacacgactccctggaggccgccaggaagcctggcacccccgcgtgcgcagcccccggcccctctccggccttcggcgcctttgaagctgcaggtttctgacctccctccctttccttctttccctttgtcccgcccggcgccctccggggctcgggaggcgccggccggggctgggggcccccacgtccctagtccagcccgggcagcccctcccctgacccctgcgctcgcagccccctcgccagagcactctccgggccctggcggccgggcgctcgctttgcaggccgggatcggggcttgggagccgagctatttgttagacccggggagagagctggcgatccccagagggaagggagccccaaacgcctttgtatgtagttgccagacaaagagaactctttgtgtagacccatttatttacaatgcaaaagctctccgaataaatattaaaaaagcttatcagctgagcaaatatgtattcacttaatacattatgttttcggttatagattaaatcaaacacaaaatagtctgcaaataagacgttttagaacccggaccataaaatatcgcaatttaaaaaggtattcagtagatggaaaacatcttaatcgctttgttgtcatggtggaatggctacaaaaacacaaggttttccgcaaagttcctaattaggaatatcaagcctatccatctcccttttgttggaggtgataaacattaaaacaatacgtatttagaagatgaggagtaatatgtgaagtgcgtccagggagcgccttcggagggacgcctgggagcacggtggtgcacgcagcttctatcactggctccgaccctccgcacccagagtctaaaattgtccccaatttcgcctgagtggatgctccgcgttgggtgggggtggaagaaaatggaggtgagggttattttaggtggccgaggtccgggcagggtctgctggcagaaggttgtgctgggccgggcccaccttccccggctagagggccgagctgggcgccgcagaccccgcgtacccaggccgcccggtactgcccggagcggagaccggcctctgctcgcggtccccggcaggcgctgaaggaagaaatcccagggccgatttgggccgttgagagagagcattctgactctgaaagcaccccccccacacacacccccaagcccccaatccgcagaggaagatcctgggcgaatttgattggggggcggggtgattgttacagcctcaacaggaagctcccggctccgggacagcaggccgggcactgcggcgtggcggcccaggtgatgccggtggcggttgcgggcctccggggctctgaggagccggcctggggtcctagcgcgatgctggggacaggagctggtcccgctggggctggggaggggggaccacggtggattcagaagaatgggccgaaagatgcatgagggggatgggagtggggagaaaaggaaggttattaaaaaaaaaaaaaactcttgagttacaatcaataaaattactcgcttaattagcatggttattcggttaagcggaatgcagtaaaagctggacctcggcatgaggtggggagagggggagagctagtgtggaccccaggccttttcctccgagacacctttgggcagcgggggaggggagagggtgtgcgtgtgagtgtgtgtgtgtgtgtgtgtgtgtgcgagtgtgcgtgatggcttcgcagatttgggtttttatcacccagcagagccagcagcctcttcgccgcggcgccctagctgcagggacccgcggggacgagaacgggaggcggcgagcagtgcggctgggttcccccggctgccccgggccaagcgtggccgggacggtgcgtgcgcgcgcggggccccgggtgctgggctgcgcgcgcgtgcggcggggagacaccgagcgccccggccccgccacccggcctggccgccgctcgctcgggccggcgggggtggggggtggggggagtgggtgagcgggcggggcggggacccccgggcgagccgagccccccagtcacccgtgtctcctctgcttttgcctccacagaccatggacccgcacagcggccgctggctcggtgcgcggccgcccgccgagaagcccagtcctcccgcgtgctgaccggccccgccgccaccaccgcctgtgaccccggacgccgccgcctctgcgccgcccgcgcgccgagccgcccccgggccccggccgcgctgctccgaggaagcggcggcggaccggggccggggcccggcatggatggccgcgactttgcgccgccgccgcatctgctgtcggagcgcgggagcctgggccaccgcagcgccgctgccgccgcgcgtctcgccccggctgggcccgccgcgcagccccccgcacacttccagccgggaaagtacttcccgtcgccgttgcccatggcttcgcacacaggtcagtgctcggccggggcgggcgcgggacgggagcgttcgagagcggaacagggcgcccacccctccgctcccgggagcagagaagctttggtttcatttcccggccccggccgcggtggctgcctgggcgctgagcggggccgcgcgtcccgccagccccccaagctgcgtcgccgcggcttagagaggcccttccctggccaccctcccccgggggtctcggaggggcagccccggagccggctgaaattaaagcctttccgcgcctcgccaccctcccccgccccctcctgcagatctaaattccacggaaacctcttttctgcattctgcattcacctccctaagacgttccggggctgggacaacgaggcgctttctgcggaaacaaaacggctgttgtggcggggggaggggaccagggtacgccgcggcctcgcggattagagtggtgtgtgcgccgggcgagcgttaatagggactgctggtgtaagacgagcaaatcctgtttctatataaagccttaaagtgtcagggcgagaatgggtttgcagggatgcatttgccttaacgagtgcctctggtatcccgctaaagccggacaaagcgtggccagagtgcggcccagcctctcagcctgcggcccggggaggagggcagcgcgggcgcgggctgggggtggcgcggggcggcgctcaggatttcggtgcaggcgagagtgcggcggatttgctccaagaggagagcgaggcggatttgctccaagaggagagcgtggggcgccgtgctgggcctcgcagggacggatcctctcgggcggtcccctctgactccctgcccgagaggatcagtccttggcagagcgggcccaggcctccagggcagccctcttcccggtggctttgatatgagtgtcgagggaggtcagggtaggggcagctaccacgcctgaagccctagaggtcaccaggcggcgcgggtagattcgggggaagcgcgcagggctgcgctagggacccgccgggtcaccctggtacatgggtggcttttgtttacagtttgttctaaacatcagaaatgtttgtcgcttttaaaaacaaaattggcagtaacagttattattggtagcttgatgaactgtgaatactaataaaattatatctgctttaatgggattacaattagtgtgtggattaaaacggatggcagagacggggctagaaaggaaaacgtcggaaaaagggagggcactcaaagaaaaacgtacattttctagaaaaaaacaaacttgaaattgcttaattgctaacgggcttccagcatttgcagcgccaggagattggaatgggggagccgcccagtggaggggtctccccagcacttcccgggttggcccacacccgcttccctccctgcctgggcctttggcgaggctgcccttttctctctgttgcccttccttctttttctccctttcttttttctcctctagatttgtaactggaaagagaaggagaaaaagcacttgcctgagcgatgggtgatttaaaaatatctcttctgctgtccctgtggttatcaagcttgtcttcctgcccctgcatgggagctgctgcccacccggctcaggtgcacggggcgctgaggctggggccgccctggcagaagggacagctcgccagcctccccaccagcccctcttctggctgaaggctggtggcccccactgggggtagggggattgtgtgcaccccacctccactgtaccgtgccctccagcctggcaagtaacagcacgacagagacaggggcccctgacactgaggcttgcatgttggtgcacaggcaggctggggctgtcccctccgggaggcaaggccaaattccccatcaggtcaggtcagcactctccctgaccccatgccccagctcacatcctggccaggtccaggccagctgcattctcccccttctgcccttacttccaggtctaggcagcacccgggtaggtgggcgcctggtcgggtggcctagccctttgtcttgctcattctaagtttggccacgtggttcttggcgtgtaggccccggagggctgtgagaaacggctctgggctctggcctggcctgtgtcctccctgcttcttcttgatcccaggtcctcccagcctccccaagcgcagggtgctctagagggcgctggaggcccctcggggctgcctctttcagggtctgaagggtcatgtgtccccgtccctggaggccccatttcctcccccctgcggaccgaagagaacgcttgtgctcggagatgttcaacccatttgtgatgggcaacttggtcatgcagacatccagctagaagcatctgtagctgaaagaaagccttttgaaattgttaagagccagaatattgtattggtttttaaaatttagctgcatgtatttttttaaaaaaagaattataccccagatcactttgctttggtctgtgtctatatatgatctagtttagagagaaaaaagcataattacgttaaacaatttttttgcgtcttgtgtgcggacttccacatggctggtttggctgccttgcttcccattttcctggatggcttcagtccgcaggccacagctgcagccagcccgcccctccctctgctgactgccccttggaaaggaaaattgacccggattcttcccgcctgtctgggagtagaatccaaccatcggggatggaggccctggcctccatgaggctgcctctttttgctgggctgctcttcctgtgcctgtctggcctggcactgccaccccggctggactgaggctgttcctgctggctgccggggctgcctttccccaaccccacccaacactttcagaatgtcagtctgaggggccctgatgggtggggacatggggctcccaggcttcttccattgtttttctaaaaatgaaagtgctgggagctttagactcgggccgcaggttttatggtaaagtgctgttccagtaaccttgtcaccaaaaggtgcaattaaaatgtttggaatcattatttttagttcagtgttagattttgtctctaatacagatggtccggaggcaaagctgtgaaatctaggggggagaaaagagaaatcaacaagaaccaacccaagatttttcatcagtgctactgcctggagccactggggctggcgcctctgctgggagtgtgtgtgtgatccgaggcagccccggcctggggagaggcccacatagacagccccccgtcctggcttctggctgggcccgctcctgtcctggtctgtacgcctcccctctccaggggccagggctccaccaaggcactatttctcatcttggtttcaataatctgctcagattcccctcccgccccttctcttgtcttctttggggtgtaaattgctgaagcctgggaaaccaggtgctctgagcctggggttattgtgggagaaaggcgaaggctccttctggtgggagaactgcaaactacttctttcctgctgaaaaagtgcttcctaccgccaatctcaaaaaaaaaaaaagaaaaagaaaataccaaaaaacacaaccaaaaaatacccccaacttggcagaggaaaaaaaaagataatttcctagtgtgaaaagaccccatcacaggctcctctccctcatcatgtgatatttttttgtaaagaaaaaaatacattttcttaaatacctcattaactccatgacacgatggagtgtttctgcaacagttagcaacattaagtaggtgtgaaaagagttactttccgaagacgtcacccgtcccgctccataagtgacagagttagacatcaaagttgccgcgagcccaaaggagctacgggaatccgggaatgtggggccgcgtggaccggcggcggtggcccgccacgcccgccccgccgaagccctgtttggaatgtgggtttcccccagtggggctcgtgctgccaccacgtctgattatcccggtacggagccgccgcgctttctgtaggaatatccaggtcacgtgagtaataaggcaaattagtgagccaggcagagaacggcgttgtgcaaatagcacatctcccctggaaaacgcgcgtccccccaaacgttccccggttattcttagaaatcttctctcatctccctgtgagacagggttcaacagcccccacagacaggacaaaatgcataggaggctgttagaataacatggatgaggctaaaaatacccctcagaaacacacataaaaaagccaaatccaacaacagaacgagctaaaaatattccaggctttggcaaagagcacagagttaaataaattatacaagagccattcatgggagcaagttgactttctctcttacgggaacttggttcaagctaataaaaataataatttactagccactgagctttgcatgagtttaaatttaattggtggggcttctggcgtttgtcacttcttggcgattagtggtcttgccctggcctgggccagagtggggaggggatgccgaggctggggctcctggcagcagggtcattgtcccctgagaagcagggcctgggtgcaagggcagattacccaggaggctggaggaggatggagactattgggggttccatccaggaaggcagaaaaagaactggcaaggcacggctattttaatttgataaatgattgtacacctttaagagtgttttaacaatcaggatacactccagcaagttgataggatgttcgctgtcaacttacatatgtcatcagagctggctgtgagcataaataatgtgcgagcgcttgggacagctgcagtctctcctggaggctgaggcgtggcaggtagcacctctgtcccctggcgggcacctttgttctccttctctctgtgtgtctggaggcagggaccggagaacagtcgtggggaatcactgaatgctgctttcatcctgggtggtttggttggggtgcctcctctctgcggactttttaggtctccccacgaaaataagagtccccagaactacttgaccagaaaagccactgtggatatgatctgaagctagaatagtagcatcgtctggtgtgttttgtttttgtttttgttttgtttttgttttttgagacagtctggctctgtctgccaggctggagtgcagtggcacaatcttggctcactgcctcactgcaacctctgcctccctggttcaagccattgtcgtgcctcagtctcccaagtagctgggattacaggcatgtaccaccacgccctaattttttgtatttttagtagagacggggtttcaccatgtttcccatgctggtcttgagctcctgagctcaagcaatctgcccaccttggcctcccaaagtgctaggattacaggtgtgagccaccgtgcccggcctctggtgtcttttgaggcagcagatgtttatatatagccacttcccaggagttttaaacatccaccctggggttggagtaagggtaactccctttactccctcctcttccttggctgtttcttaactcaatctgcctcccccgcccccaatcctggcagggccttctaactcccaaaggactatatttcccagaataccctgatctagctccagggtctgagcccgagactgtccatgtccctgggctgggaattcccaagcacagatagagttcagccagtgccgctgggaataaatactttcctggtggaagaaagccttgctccatcgtgcccccctgcccttccttctggaagaggcttctgggccccccggtctggcttcctccctaccataaatacctgaatataggcccataacaaatgggacctgtcctctgtcctctgccctctggatcctgtgaggcagctactgtgattgtcctggccaacgccccaccggagagtctcccccaaccccctgagctcagtacatggcatatgccctcttttggagtggtcttctcagaggggcctggttgcccatcagctgctgtggaagcgatacagggactcctcctgggtagcagcagggccagcctctgcctagggagtccctcgagaaaataccgcccagcctttggggtgcccccttgccctcctgacaccctcaaacaacagaagctgcctgccttcttaatgggttcatcctgaatgagaggtttccaaaaagaagccctccctcaagacaggcactgccttgttcccctgaggagggaggcaggctcgtcctggcctgtccaggggagggtccgaaacccttggctcctggacagcctccttgaggggagatggcctccccttgtgtcccccacctcgcagacgtgctgtgaatgggcttggactcagagcacgcccctgtctgttgggtaggtgggttacttgctctgcattccccctcccagcccccgctccccgcccacctgggaacggcttccctggggttccccggtccccattaacctctgggacctcatttcccctcaccgaagacacagtgtaacaagcaaaaaaaacatcagagccagcgtgcagtgtctggaaaatcacccgcagcccaggcccttctgcaaaggatggggcctggaagggcctcgggcgtgggaccgcactccgctcgggctccgcccgctgacgtttttatgggataatataccgtttcgctcacgcaggcctatttgtcagtgggctgcccctgtttgttgtaatctataatattactgcctcccgtggccccagagcagctgccgcgggagaatccagggatggtgggcgctaggtgtgcgctgaggggatgtggtggcaggcgctgggggcaggcggcgcccaggtcctggttatgaggtcggcgcggggtttgcagcgagcctcgggtctggtggggaggcgtccagcgcccaagctgggagccagccgggctggcatgctgcagctgtccacacgattaggttcccgatcggatcagccaggaagtgggtttttttcattctgacctgctgtggcgaggaagggagggacaaacaggtgggctgggttcctgccttcccttctctcccctaggatcccccaagaaaaagtccagtgtcttgagatgcggggactctgaggctggccggaagtgctgcccctctccggggtctgtgggagacccactgtcacttgcaactgtgaggaacggcagagcagccccttgccccagctcagtgcagggacatggttttccagtggaaatttccagaaatgggggatgggtgtgcttccaatagggtcctctgagcagcaggctgggctccctgaagcggagggtgacattggggggcagtgccttcttggggtaccccaccaaaaaagagaagccttagccatattaagtaagaaagaaaccagcctgctggcgtcttcaagggaagtcgggtctcagtgcgactccctctctctccggtccttggagcacagttgaagctttgctttcttcccctgagacttctgcaaccaggggcgcctcctgttcttaacacatggcatgggtgagagtgagcagatccagggaagaagagatgggggatgcccagaccggagacccaagagacctgagcccaggatgggggtgccatggtgggtgggagaaggggctgcgctgtggggcaggtcccctctcaggcatgaacagacattgccgcctggcaggggtttcctggctctgtggacgtagagctgtggccccctcttgggtgaggcccactctgcagaccccagtaaggatatcccagcggggtctagccacaggttcactgaccaagctcacagctgctcacactcacagatgtggcaacatacacctgctcctgtgtgctcacaccatgaggcaggtgttcacctgcacacacacactcacactgttcacaactggcccacaaggagtcccactccagtggcccctgggaaagccaggttgcttagtgactggcacgggcacctgtctgccccctacgtcctccccaactgctccatcctccgtctcctggctcctggttcctggccacctgcaggagggagcagagccccagatccacatgaccctctgtggctcagcctcccttcagcgccttccccggcccccttcctcctgctgcccctgtgtggctgtggaccgtgtcctcgggctccagctgaacttggccttgccctttcctgagctcttgctcggcaggaggaggacattcccgtcaagatcaattccagtgcgtggcgaatgcctcggggccaggtctggtcccgggcctgccctgaggctgtctggttgtcctggaagccgctgcctgcatggggcactgcttcctgtcctgtgtggccacctccaccccaggcctctgcgcctggggtcctagaggttcctagatgctcggctaccccaggccccacctgcctcccaccccccaggctcccaccctgcacccccacctctcagctgccctcagtaccgtctctgcccaccgtgccctgcccctcctggggcctacccctgcctggccctttacttgggcagcttctacaatccccagtgcctgcccctgccaccctggagttctgatcccggcgtcacatcctctcagagcccccgtgtgactctgcctaagtggagaggggtccccgactgctccatgcccacctctcctttcctccatgccccacaccagctgagctgttcttggcctgcagcccttcttgtccccttctatgacctcccagccctgaccacccacctgggtctgtcccacagagcctggcagcagcccctgcccagcccccctggctggcttgtttggggccagtgcctttcccctgatatcagccacctttcctgggagactgcaggctcctgagtctgggggtggaaatgtccttctgtcccttcctatccccagagctgggctgagccacactggcctccgtctcctgccccagtgcataagtgcccatccacgctcaggtgacgcgcacaggcacgcgtgtgtgggtgtgaagagctctgcttttcccctaggatttcacccccacaccggaaaagatgaacgattaactctgggaaaactaagttaggaggtggcagtggtgagagacccagccagggtctctggtctctttattaaaaatcaaggtgttccccccacactggaccatggcgtggggccacaggctgcgtgggcacctgcctgggggacatggcagcatcccctggccttcgtgtagcatcttcagttgtcatggcggctcctgaggctgtgtgcgctacaccttaaagggtgtcagagcccaggggattggcagatggcgctgtcctctcctgattagcgccacacgaggtggtgggagacagaagtgggggtggggctcctgtcccccgaaggctggagctgcgccggctgagtggcctggggaaggggggaagtgcgtgtgaatggagggaggcagcccacagctgtgaaggagggttctggagggccaggagcgggctcagggtgggggccagttccttttcacctcgtggccctggctggggctgtgaggcgactccctgattgtccacgcggggtcgcgggggtgcagctaggattgggagcaagagccagtggcttcatctgggtcatagagcactagtgggtgaggagggacacctggggagggctgcctctccccgcccaagggcctgctccccttgccactgaccagagggaaatcgggcccagggagaaggccgggtgtgaatcagctgcctcaccctctgcgacgtctccatccacaggccggccctgcaagcacctccccagcaggctgggctgtgccagcgagggggagaccatggccctgggactcatgtcaccaggcaacagcgctgcctcaggcccttcacattgtgggttttgccttccagtcttcaggcccgggagagcacctggcctcagcgcctgcccgagctgaggggagcgtgtgtaatggggccctgccaagccaccttggctgcagctgccccggcctaaggtggggatcggtggcccctgctcttccctccctgagtctaggcctcctacctctaaaatgggcagttgccctgccctgctggagggttgagtgggactgggggatgcagttgtggccccggtgccctcccaggagcactgtggccgtccgtgtcacctgtgggggtcctaggagcctgcacgagctgccggaggcacatggcctgtgcacgccccttccctggcggagactcagaggcctggggaggaggcggctgtacctgggacccttggtggggcctcccccctgggcagcaggcagcgagactcctgagggcccacctcatgcctcaggcccaggccctctcctctgtgtccatcgagggattctgtggccttgaggccttagtctggccgtagaactaggaaacctgggcccttggctcctgtgccctggcacgggggtccagctgccccacttacccctacctgtgcaggggcttgcatggttttggtgtgaaggtggacgcccaccctccagcatgtcctggggcgttggatgtgactgggatgggcagatgtggacctgctctgaggcaccacgggtcgaggcaccacgggtcctggcaccacgggtcctggcaccacgggcagtgcagacgctctggacccccaggtggggcccaggtgctggggggccttcgtggccttccgggtctactgggctctgggacttcagagagcttcccagtggcagagggggactggcccaggggagacaccagcagatcatgtgggatgggaccacagagctggaagagcaaagatgtccccgtatccccccagtctcggggcgggggtgggggctctctgcctggggttgggggacaatgaagcaggctatgcttccccggagtccaggggtggggatggccgctcatcaaacactctgctcccccagggcgggtctcagacctctctaggtccctcccatgaaaggagggcttcggagccgcacctgggtctttgttgtccatatgtctgtgtgaaggcctggggcccccgtgcgcctcccctcgggcctgaggggtccctctctctggggtcacgctcccttgttctcagtcccgcagccgtcctctgcgtgagtccattcatcacgtgcctgcaggtgcctgtgtcctgtctctgccccaggctgaggccgagggtctgcgccacctgggcatgcccagtggggccccaggaggactcgccacccccagttgagcagctccccttctcggcagctcccaaaccctgaccccagacaggcagcaggagctggacgtgccgtcagcccaggcccctgagagtgaggctggagagacgggaggcaccggtgccctgtgggtgggagcactgctggctccatcctccactgcattcaaattgatcagggagggtggggttgggggggaacagggtccttgaggtcgtcagccagccccacccctgcctgcctgcctgcctgcctgcctgcctgcctgcctgccttccttccttccttccttccttccttccttccttccttccttccttccttccttccttgagaggcctctctacccagcacccacgaagacgggtgagctgctggccacccgaagagggtgtggggtggtcaggtttggggcattccagacctgaggccctccaggcagctccccttccactctgcccagcccaccctgccagggaggcctcagcatagtccttgagctctgggggccccaacccagcctccctgggtctctgggcctttgcctctacccacacctgcacgcctcagcaaggtcgttcccgacaagcccctcaccgccccggcccctgcccctccacaccctggtcactcttccctccagctcagcgcttaccatcgtatccctgcatccgagggtagctttgccacaggaagcatttgcattcagcgagacacacaggcgcacagggactcaagtgtggccacgattagggcaggaccagggccccgtggcctcctggtttctggcttcagctggtgacccccaggaggcctgatggcaggtcccccgtccctggccggtgagctggctgtggagtggcaggaaagagcccagctctgtggtcccccaggatcctccggatctccgtagtgggacagctaccccatccggccagccctgccgtgggccctggtcactccaggccagcaggtcgccttgtgggcagttttcctggaagccagtcccctctctgagagttttcatatccctttgggtgtcctaaaaataaacttttaatttattttaattgaataccaaaattaacttaaattgtaatgcatttttgggctaactcttaaaaagcccttagtgtgtgtaaatacagataaaatcaaagaaaattcaaaaagtgtatgtgaggccatgccatccttctaacaagttgagagtttgatggtaaatacttagcagaaatccaaagtgcctaagtctggagggcctcaggtgggaggcggctgggggtcagagaccccttggggcccgtcggccagggcagggagcagccaccacgcttcagcctgcgttgctgactcgtgcacgaggcaggtctgtctggagtcaccgactctccctcctggcccttcccgtaccttcccgggggctctttccccgtccgcgccccccgccccaccctgtggctctgtctcttccctgcatgagtagctggggctctctcccacatgatctcacaactgggtagcttaaaacagcgaacattgattatttcacagcttctgtgagtcgggaatctgactcagggccaggtgttggctggggcctcggacatatccagacccagctgtggggagtcccctccagaggccaccctccggctgtcgtgggtgtgggagtgttgccggctgctggctggaaggagagagtgagagagcgcaggacggaagctcggtgcgggtgcggcctcaccttgcgggggcagtgggtgggtgtcacttcctccacatcctctttctagaaacgagtccaggtcccgcccacaccaagcgccaattacataaaggtgaacaccagggtccagggttatcagggccttctctgaggccccccacagcagccatacgctccccaaccccagagtgggccgtcgggaccccacccgtggctgtggctgcctcccctgtgctgaccatgccccccccgggcgctcgctgctggctgggggagacctgccctcgggggtttgtgcctttcctctgccccatgccctcggcctccttccctgtgacttggccaagcgtaagccccgggctcactggaagcctcgctccttctcagcctctgcacccccgtgccagcctggtcctggacatctgaggcgaggctggccctgttcgtccctcacccctcttcctcccccttctgtcttccccccacaccacaccaccgcctccactctgggctgtcccctccgcagcagcgggcccctggatacccgtggaccgtccccaccccagccagggcagtgctgtccacgcaggtgcagtatcgtctcagcacctgtgggaggtccgttcccagacgtcctgccttggtggagtgagcagaccccgaagcagccacaaggccgcgggggctgcagcaaggtcccagggcccatgcgggaggcagcccgctcggaccacctgtggcttccctgcactccaggctgggctcagggcgcgggtgcgtgaccctggcctgtcatgggcactcagcaactgttcgtgtaccagccgggttaaggtgtccttctctggatggggcgcagggctcgctatggggtgctggggcggctgtgtcctctggtctgggcagcgctttctccttccgtttctgcatcagctgcctgcctgggtggggtccgcaggtgcgtcagccaccccgggggctcccccagcccaccttgagctgacgctggcagcccacctgggtgcccttgggatggggagctggccctggacctggcctgctggatccatgtggtctgagcgtgtctctagactctcctctgaagctgtgggggtgccttctgagccctgacccgtgccaaggagcccccgcacagcagcccaagccacctgcccaggaccagccgtggccccctcgatgtccgccttggcagcagagcggctcctcccatggcaggacctgtgctggggcaggggcaacggtgtgggggcacctccttcagcgagggccaatgcctggcgccctggcctctggggcaggtcttgtctgggcagcagaggctcaggagggcgctggttctcccagtggtccgtgaggccggcagggcatgcaggcggccagcatcacggcccggaccccacagaggcggagctcgggctgtggggttgggtgctgagggcactaggagctgccggacctcaccagggccttttctccctcggacctcccgtctgggccccaaaccccctcggccagccccatctaccccatcccagaggtccctgcctgagccacccacctcgcccgctcccctgcagagttcctaggaacgccgagtttttacctcagaggctgaggtgaaaagtaagatgaataagatgaacgtgtgtgtcgtgaggacgtgggtccgtgcggcaggagcgctggccgtcgggagggcctggtgtggccgtcgggggcaggagggaccgaggttccccggggttcgtcacagcctcaccacgtgtccccaaccccaaggccccgggacggggtgaggctgggggcggaggcggcaggcaccccctgggcccagccgtgcccactcccctgatcgctgccacgctgcgctgagaagtcctgtgtgttccctggatcccggtgtggtctccgtctcccaccccggcctgtcgcatccccacccgactggccattacccgccacggtgtactatcctcgccagcagctgttacccgccccggcgtactgtcctcgccagcagccgtgcactctgcacgtttgccccctggttcccattggagctctgcccttcccgccccggcccctcttccagggccaccagatgctgcgcggggggctggggacgggcccgggcgagggagctggaggagggcacctggccgtgtgacccccaccctctgagacccgtccgctggcagcttcctggttccttcctctcctccacccatcttcctggaccctgggtttgcccatgcctggctcggtgccacacagcaggggacaggtgtgctcagcctcttggggtcgcagcagggtgctgcctggaggggagttccaagggggaccttcgttgtgaaggagggcaggctgggctttttgaaggtggctgggtgtgaaccacgccttgagacacagagtttggcagggggcatacgtccccctggaagggtaacgcgagcgcgaggccccatgtggttggagccagctgtaccaaaagcagttggctgggaaataacagaaaatggcactttagtgggggccggtccctgccctttcagcctgcagtgacctgtgctggccccagccccttcctgggatactacagcctgagccaacctcgttttgggagtcgggctcttggcacctggtccttcttagcaccaggggcaggagtgacctgagtcccctcggtgggaggtggagctctcccggccaacatagccacctccatgctggatgtggtgatcacagcgtgcgaagctgtccctgctccctgacctaccccccagccctgcttaagctgactgacacagaccatagtttctctcacctgggtgcggggaccccagctctgggggctgcaactacccacagaaccatcgaggacggcccaggatggctgtgggcagagcgccccaccctgccagggagaccatgggcctcacacctccaggcaggccaggctgggaaacaatgtgtgcgtgtgcgtgtgtccatgaggatgggtgtatgcgcgtgtgtgtgtgtccatgaggatgggtgtatgcgcatgtgtgcgtgtgtgtccatgaggatgggtgtatgtgcgtgtgtgcgtgtgtgtccatgaggatgggtgtgtgtgtgtccatgagggtgggtctatgcgtgtgtccatgaggatgggtgtatgtgcgtgtgtgcatgtgtccatgagggtgggtgtatgcgcgtgtgtacgtgtatgtgtgtccatgagggtgggtgtatgcgtgtgtgtacgtgtgtgtgtccatgagggtgggtgtatgtgcatatgtgtgtgtccatgagggtgggtgtatgcgtgtgtgtccatgaggatgggtgtgtgtgtgtccatgagggtgggtctatgcgtgtgtccatgaggatgggtgtatgcgcgtgtgtacgtgtatgtgtgtccatgagggtgggtgtatgtgcgtgtgtgtgtgtccattgagggtgtgtgtgtgtgtgtgtgtccatgaggatgggtgtgtgcatgtgtgcgtgtgtgtccatgaggatgggtgtgtgcgtgtttgtgtgtacatgaggatgggtgtatgtgcgtgtgtgtgtgtccgtgaggatggtgtatgcgcgtatgtacgtgtgtgtgtccatgaggatgggtgtatgcacatgtacatgtccacaaggatgggtgagcacacaggagggtgagagcctgcccccctggccatcccgagcctgcacctgcctccgcccacctttcttcagctgctctggcatggagcctgtgtcattgacgtcgcctgtttgggccaggtggcaggagttaggagcacgctcgcagcctgtggctggtccacttggaggatgggagaggctggccagcagggccacatggctatgtggacacagggccaagagcactagagtctccctacagcccggctctgtcggggctcatcctatggctgctgtgcccagggaggccttgcacccccatccgttgccgtgttgtcccctgcatgtccacagctagactggacatgtccagggtcagggcagggggtgggggctccggttgagaggccggagtgtaggagggcaggtgggtgtccacgtggcctcccttgctctgcagggacccgagggccagggtggattcctgggctggggtgtgcgtgcgtgtgcccctgacatcttcaccggggtgtccgtctccccgcagctggctgtctcaagatggtgggatgggaagcgttcagtttggggcgaggagactcatccagctgcggggggcggcgccgagggagtggcgctgaccaccctggttgcattcccacgcccctggccgaccgccccacagccctccagagtgtcttaggggcaaggggaggtcctggccacccgcctgcccaggagagcgggtgagagacatgggagaaggtgtgaagaattggagaagcagagagggagcctgcctgtgccccaccctcagtccccaccatggctgctctgagtcacttggcacagagctctcaggggagggagaccgaggagggacgccatggggagcgtcggccaccccccccccgccctagccaaagggctaaatttacccttttaataagaaccagacttatatccgattttccttttcttttattagttctgggctgtcggtggctgagcccatcctgtcatcatcacctccgggccgtttccacgctgattgggttgggtacacagcaaccacagagttttcctattaaggcctgagagacgctgcctctgggccagcgcaggcttctggaaggttctcctgagccagccaaggggcttcccgggtgacgtgctcctgttcctgggcgggcgcccctcccacaggctgctgcaggtcccgggctgagcccatggctgcatgctcttggccttccctgcagcccctccctcgctgcccccacactgcttcccatcctttcgcacctcgtttttctctgttactcctttctccctgtgcccgcctcagtctccacttgtccagctgccttcgtggagccacaggtggtggggaggtttggtggccccagggggccaaggcaccctcagacacttccaggctgtgggggcagaagaggcaacagtaagcagggcgggccccgtgtccaccaggtgtggagggagcagtgctggacagacggacatctggtggcagcaggtgtgcagtcgggacagagcgccgccccgaatctggacagtttgcgggccctggagagggcttcagattggagagggttccaggacagcccgagaaacattgggtcctgcttctccaccacagaggggagctgggcctggccacgtgacctgttggctgcccgccagaatctacaagactcccaagggccactttagggtctggggtctcactgccccaggagacgcagctcagaactgagcagctgtgccgggtcagggtctggttcccatgcagcagtgggctggggggctggagctgcaacttgatggagatctgaggcccccctctaccaccagtgggccgggacatgccccgacccagggcagctgttcatcccggtgccgcttcaatgccaccttttgcacagcggaggccaagagcccttgccaaggttcaggtcagtaagtggataagtctggtggaggcctgagccctgggaagcagcatctttgaggacttgcccagctgtgtggctcccatgcccgagaacagagtctgccaaggtgcgcacacccacagacgtgtgtgtgtgtacgtgtgtgtacgtgtgtgtgtacgtgtgtgcgtgtgtgtgtgtacgtgtgtgtgtgtgtgtgtgtgtagccactcatcccagacatgtagcacagtcagaccttgtgtgtacacccatagtcacgtgcatatgcccagagacaggtttgcacagacacaccccgtgagtcacacacagtccctcccctgcctctgtgcaagtgtgagtgtgtgcaagtgtgagtgtgtgcaagtgtgaggtgcaccccacatctcgagtctggaccactagtgattgcagccagggtgggggaagcatcactgggttgtatctgggggttgagcctgcaaacacctgcacacccagcatgcacctgcctgtctcccagccacatctgcacactggggtggcatgtggctgggcctctagcccctgccacagcagcttctggtctcctggtgcgggcggaggtcccagagtggcctctcaccccaggcagagcctggtctccccaccccgtccctcattcctctttctgggcagccaaatggtcagatgctacacccctgcctccaagcaggctgcacctcccctctgcatccacgcaggaacctgtgcagggcggcttcctccccgcgctttcccggaatgaggaatgtggggcagggccagcaggggggctgctcctccttcctgcctcccctcccgtcctgcacagctcccttgggagcctggctcgtgggaagtgtgcttgggaccgcccatcactccgttcccagccactcctggtgtcccccgcctgggcgggccctgtggggagcggggaaggtgtggagcggaagccagtgccgagggaagaggggagcctgagtgggtgtgggtcgggggtgggagctgacgcaggcggcgggtgcagccgccagactcggagccggggaggcccatgccagcagcccggcagctgggcttccggaagcagcgggagccgggagcctgggaagggcctcgctgcttctctggagctgccgccatctcaacgaggcgtttttttttttttttttttttacaacccatttcacagtttccagaaaaggaggatgctgtctcggcggctcacttaactcaaaacaaatgctcgctctgccggctccgcgcccgcctctcccggctcccgggccctgccgtcctcttgttccgtctgccttcagtctggtgccacagggcggagcagggtcagcctggcaggagagtggggtggggcacagtgggcacctggccatccgattgcccaggcccagcctctgctgtgtgggtcctcgggaccctggatgggggctgctggcacggctgctggaccgacccttacagagggagtggctctccggggagtcctgggctccagggccccagcatgctctgtacccctcaggctgcccagcatgtgttgcccttcttagccatccatggcaaggagcctggaagacaggttggcaggaggcaggctagttcccatcggctgtcctggccacttagggccacctctgctgtaagcccatgtggccagctctcacctactgtgtgccggcctccccacacagcacccctgggccggggccaggctcactgggcaccgagactccagcccagctgttgtgcagctgttccccagtcttcccgctgctgggccaccctgggacagcaggtccaggcacagcctgcctcctggtctagttggctggaccttgggctccgggtcagactggcctcccagggatggggctgtgcccgaggacctgagccacctgggggtggccacagccctcctggtgttgctgtctcccgaaaccatttcctcagctagccggccgcccaagccaggcctctacagcatcttgggcagagctgaggtggccctggagctggggccagagcccggtctggatctagagctgcaaacccggcctgggccggctgggcagtgggggcagccaactggaggccagtgtgcagtcctcggtggccccgctgacaccgcatcccgcttactgtcccttccccaggaacatcctaaactcatgctgcctcctgtgatgagagctgatgggaagcctggcagagcggccccaggcaggctctgtgtggggccagggtgccctgaccatgcacgcgggtggggacaggccgtgttcagcccccagcggagcacttggggctatgggcctggaccagcaacttagacttggtcatgctccatctcttaccagccccatggcgggcccacgaccgaccttgggagcatgatggcactacgtcacatgagtctgaagccccaggtaggggaggtgccactgcaggcagtgccaggatggggcacttggtctgaggaggtctaggtcaagaccccctccctggcccccagctgcctccgcctgggctggtaaccacagcacttcctttgccaagaggaaagagccctcagcccggttcccggctggccttggcccacacggtctggccctggctggagcccaggctacactcggctcccaggcagctgaggcacaggctctgtctggggttggccactggtcggcgggggggctggggaggtggcagcctggtctgcccacggctctgctggccagtcacggtgccatccccaaacaccgggaggcgggggtgacagtagaggcgtgatgctctgtcctggggtttcccgggctcctcgggagctgagtgggatagggagggcctcaggtggccggcagtcccgtcccccacactcgcaggggtcaccacagtagtgaccacctggcagggcctgcagaatctgcttccaagtttcaagccaaggccaggacagtgggggagaaatccacgcctttagagtaagcatctgagagcccccagccgtgtgcagggcccctgctcacggggcaagggggatgccgggcagaggctcttcccctgcctggtcccgtctccgaggtgctggcctgctgagcagccagtgagacgccctggcagcagctgccgccagagccaggatttccagaagcaagaggccaccccagtcccttgggggggatggtagggtctctcatggtaggctcagtacgcaggatgcctgggcacggaattggggtgcagcatgcgaccccatgtgatactggagaagggtatttgcagctgtgcccagaagtggtcccagaacgctcatgcgagggcctcagggccggggtctcgggtgactccgcttcctctcgtgatttttttttttcttggaggcggagtcgcactttgtcatccaggcgggagggcagtggaacaatctctgctcactgcaacccctgcctcccagattcaagcaattctcccgcctcagcctcccaaatagctgggattacaggtgcgcaccaccatgcccggataatttctgtatttttagtagagacagggtttcaccttgttggccagggtggtcttgaactcctcacctcaagtgatccaccaccttggcctcccaaagtgctgggattacaggcgtgagccaccgtgtctggtctctcttgtgctttattacctgagcttattatggtgaaaatacaaagacataatgtttgtatgacaaggagacagcaatccaggtggcccgtttccagaatgaaagggaaaaagaagtgaaagagatccccagatcagcagccctgcctgactctgggcacagacagcactttgggacccccagcttggtgaggctggtcaggtgcagggaggggctaggctagagcccccatccccttccctctcattccccagactgtggggccggggacccttcctcagtgggctcagataaggcagcacagcagggtcccccaagtccggagacaggctggttgcccactgagggccccgtgggacaccggggagtgtcctgcccccacctgatgtggtgtgggagagctcaaggtacagggttctcaggccaggatcctggagaaatcccttctccagacccaacttttggacttagttgcttcccaccatcccgaggaggaaaaggcgggagggacttccccaggagggtgtgggggtgggaaggcctgggggactcgaggcgggcctgggcgaggcagcggcaagcttccaactccgaggggagcccacactcaccccacaggcatgccccagtgtccccaagcaggggaagccagcacttcccttcccaacccagagtcccctccctggctgccgggcctgtggtctggccccggcccatggcagtcccagccttgtggtccgggaagcccctggctcgcgggcaccttcaccccctgccctgggcctgggcctggccctgctccacagtcccttgggccggctcttcctctccacccgcccacccgccgcagaggccagctcacagcccacgtcccccaccagcactcacagacccctcctctgctgccatgactgggagaggccccttgagtccacatggctgcgttcgcacacgagaggggaaggggccttgggggccctgggctgggaactggctcagcacagcaggagcctgccagggccgtgcagggcagcccccgccgccccccttgccccaccgcctctgctgagtcacctcatgtctgggaagttcccagggccaagccaggctggatgaggcatcagaaattcacaaattccccctgcctcccgggcaggggaatggctgtcctgactcacctcgggctgggcccccgcagaccccactatccccacgctcagcctcatacccctctttcccgagggggcaggccccccgccccaggttcctggaatggtcccaggccaggcttgctgcccgtgggatggagacgacaaggtgccagggtgcctggctggagtgggggccgctcagtgacagcctcagaccacccacggagcagcagggccaccgtgtgcagaaatctgtgtgtgctgtgtcctccgtgtgcaggagccgatagtcatggcaactctgggaggctccctcgggctggccttggccactggacttgggcagaggtgggcacagctgaggggccacaggcaagcatgcaggcgggccgatggtccgggagagctgggctgggcggggcctggggcgctgggggctcaccatttcccacactcaggctgccaggagaagtgcggggtatcctggcggtgcccaggaaggagcctctcgcggcctccacctgacccagaggtgagcgccatccgcagctctgtgccagcccagtcggggcccagccccaggaatcctgaagggattttagaagcagatccgtcctcagcgccacccttccttcctctgtcccccgccctcagtcttccccctggctcagtttctccctctgctcgcctgagactggggcactcctgtctgacaagtcagtttattgggcctgggtagagggatgaagaccccactcaggagagagaacagctcctcccagtgctgcctggaggggccgagactgtggggcccgtggagctgacacagggcctatggctggggccccgctgaccctggtgcctcatgtatcaccttgacctttttggcaagttcgccagtgtgtgagaggccttggagctgcccacagctgtgggctgggagagtcagggtgctctccctgtgaagaggaggcccatccacagaccctgaaagttgattgggcacagtacccagcacccacctgggtggtagtggtggtgacagtgatggtggtggtggcgagtgatgtggttattgatgatgattggtgattgatgatgatatggttgttgtggttggtgatggtggtggtggtgtggttgttgttgaatgtggttggtaatggtggtggatgatgtggttggtggtaatggtagtggtgatgtggttgggggcatggtggtggaggtgatgtggttggtgatgataatgtggttggtgttgtgtggtggtggtgatggtgatgtagttggggtggtgttgatgtggttggtggtggtgggtgatgtggtttgtggtgatagtgctgggtgatatggttggtgatgatgatgtggttggtgacaggtgatgtggttggtggtgatgatgatggtaggtgatgtggtagtaatgtggttggtggtgatgtggttggtgtgatgtggttggtgctgatagtggtgggtgatgtggttggcatgatgtggttggtgtgatgtggttggtggtgatagtgatgggtgatgtggttggtgatgatgtggttgggggtgatagtggtgggtgatgtggttggtggtgatgtggttggtgggtgatgtggttggtggtgatagtggtgggtgatgtggttgggggtgatagtggtgggtgatgtggttgggggtgatggtgggtgttgtggttggtggtgatagtggtgggtgatgtggttggtgatgatggtgggtgatgtggttggtggtgatgtggttgggggtgatagtggtgatgatgtggttgggggtgatagtggtgggtgtgtagttgggggtgatagtggtgggtgatgtggttgggggtgatagtggtgggtgatgtggttggtggtgatagtggtgggtgatgtggttggtggtgtggttggtggtgatagtggtgggtgatgtggttggtgggtgatgtggttggtggtgatgtggttgggggtgatagtggtgggtgatgtggttggtgtgatgtggttggtgggtgatgtggttgggggtgatagtggtgggtgatgtggttggtgtgatgtggttggtgggtgatgtggttggtggtgatgtggttgggggtgatagtggtgggtgatgtggttgggggtgatagtggtgggtgatgtggttggtggttatgtggttggtggtgatgtggttggtggtgatggtgggtgatgtggttggtggcgatgtggttggtggtgatagtggtgggtgatgtggttggtggtgatgtggttggtgtgatgtggttggtggtgatgtggttggtgatgatgtggttgagggtgatggtgggtcgtggtggtggtgggtaatgtggttggtgatttggtgatgatgtggttggtggtggtggtgggtgatgtggttggtggtgatgtggttggtgggtgatgtcattggtgatgtggttggtgcatgatgtgattggtgatgtggttggtggtgatgtggttggtggtgatagtggtgggtgtggttggtgatgatgtggttgggggtgatggtgggtgatgtggttggtggtgatgtggctcgtggtggtggtggtgggtgatgtggtccccaggcccacccttccccccatccccaggcccaacctccccccccatccccaggcccacccttccccccatccccaggaaggctgcgctcctccctgtggggttggtgcctggatcctgggcaggctgcccactgcgttcattctggaggctcccatgggaacctggcacctgctcccgctcttagctaccttgctcagcctgggaacagatggagctggcccggcccgcccctgaggcagctgtgggtcaccacttgggccagttccctgcaggcctgtggatggggaagaggctgagcttctgaagcctcagggggccccaaggattgggcactccagctccaagaacgaatctcttgctgtgccgccccgcaaccactcatgtcccgggagctgcactttgaaacacagcctggacacccgggggcctgcccacctggggtgaggggccgtgtgtgggagcaggggtgtatggcagagagcagacaggactagggaaggggccgctgcaaggctgtaggcccttccggccctagagtgggagtgggaactgcccatagctgcagtcactgctgaggcccctcctgtgcccagggctggagtcatcagtccaccgaggcccctcctgtgcccagggcaggagtcatcagtccaccgaggtccctgtgtgcccagggcaggtgtcatcagtccaccgaggcccctcctgtgcttagggcaggtgtcatcagtccaccgaggtccccgtgtgctcagggcaggtgtcatcagtccaccaaggcccctcctgtgcccagggcaggagtcatcagtccaccgaggcccctgtgtgccccgggcaggtgtcatcagtccaccgaggcccctcctgtgccccgggcaggtgtcgtcagtccaccgaggtccccgtgtgctcagggcagccatcatccgtcaactacagcactttgtgtgccgcatgcggacagggtttcagaatctgtgtcagcccagcactcggggcctggcggtcatcgggtagacccgtgcactgcacctgaaacccactgacaccctgagtgacgggggtgtcccgtgaagagccagtgctgagttgcgggcgggtggaggccaggctgagcctcgtgcgtgtggctgcacggcagggacgtcctgcgtgacagggacgatgtgcagaacctcaagaggagcagggaccacttgccaggccaggggtctcccgggactcccctggggtcactgtggggggagtaacaggggatctggcagagttggcaggaggtgggggaggggtgtctgcttctgagccaggaggatgggccctcgctggacagtgggtatttgagacagtgcccacagcctcccacgttccccagggcctcccaggctggctgcccacgtgcacattccaggctcggggccacgcccagctgactgcatgacccactgcccgcccagccaggcgcatgtgggagccgaggtggtactgcagtgggagacaggtcgaggctcagccgtgggaggccagcgtggcagaccttcccccagggaggaggcactgccgtttgtcaggatggtggggtgtccgctgtagaaggttttgtcctcaaaggcgtgcgggctggggcagggcgctcgaggtgtgcttcagcacccccagaagtttgctgagcctgcagcatcctggccctgagctctgtggccccaagtggggcttcctgggtgaccctgcagtgggaagtcccctgaccccccaggtgatcttggtccttctgctggctggcgtccctccctcctagacctggccgtgaagataccccaagttcagcatcctgagagacccaggagcagcccctggttttccacggcagggatgctccctggaagggcagcctggggggtgggttgtggccacctccccagatctggcaagaggaggaaggcgcagggctggcctggagagggcagggcctcgacgtgcggggctgttgggaaaatgtgctgtgtcagaacgcaggagggatgagggggatgaggtacctggagtgggggtgcccgtcaggcagccagggctggtgcaccctgggtgggggctcctcctccctccccaggggtgagaagccaccaggcctcccttctccaggtgggcaggaggaaaggaagggtcccctcacccctggccgtccccagcccccatttctctgcacggtgccctcccactcctctgtccttcagccctgccccaggggcacccccgacccccactgactgcccactctctctcctcctgcccacaccacaggcctcctacctgcaacccttgacctccccagacgtggtgagctcaggcctgggggtggttgggaggggtctgggggtgtggccattgtgtcccccgcccagcccacgcgtggccccctggctttactaacccatcaggtgcctgtggctttgagcctctgtctcctgcagtctgtcccatcacaggactgagtttggagtctcctgcccaccgcagtagcaggggcaggatgtggggacctcggtgcgacccccactgcccccagggctcttccccacgctccaccaggctccgagggcaccagcagcctgtgtcctgaccacctctctggcggttcgcttagcccagggcttgcccttgtctgttggggtgatcataaaagctcccgtctcaaaggggtctgggaaggggaggttctggagccccgacgttctagcaggagcttgcagttgaggacctctggctctgggttcatatggccccagaccctgctggctgagccctcttggtctctggccccggaatgtcccctccctgccatctggggcctctactgtccccctggagccctccccaggaccaccacccccactcctcagtggcaaccccttccaggatgcctgtgtgtccccggcccggccgcagcagccctgccttcccccactcctcagtggcagccccttccaggatgcctgtgtgtccccggcccagccacagcagccctgccttctggcttctggcctcagaacagctgctctgattcataaaaatcatttttaaattttctttctcagttttgagagtatggtcttattgggaaaaagaaaggggctttctgtcgctgggctgggaggaccttttcccttcctttctctgccccctgcccaaagatgaccccaccctgccgactgggcctctccggcacccagcccctccctctctgctccccgcccctccatcccatctccccactccctcctccttccctggctccctaacttcccctctgggtcctcagaggtggggacccaagcaggcaaggatgggggcaccagccaggcctttggtcttcgggccctggccagtgctgccctgctcaccagcccaggggccaccagccaaggcccagcagctgagggacacgcatagctgcccacccgcagctgcccccagaggggaccggcgggaaggagcccactcctctgccagctgactgcctgctccccgcagagagcggatgggctggaggcctggacctctggaggggggaccggggctccgtgcctgggaaacggtgtctgggaaggaggaatttacagacttctgtttaccaaaatgaggcctcgtaaaacatttaacagcagccaattaaagggggacagctgtggaggtttaacagtaccccccaaggccctgccccttgccctgccactcccctacccccgccccaggtcgctcccaccccgtccctctcagctttggtcgaatcttccaggattggagtttaatctggtaaacagctgctccagatgcagctcccacacagaccaggccagtcggccaggctcgagcctcagccccgtgtcctcagctggagggcagctgcagggctgcaccagggccagggcgccctccccaggttcccagacttggcctgggatgtgcggcctcacagggagatggggcttcaccctgtcaagcaggcctccgtgtcgcaggacttcccagggccttccctgtgctcacgccctacacgactccaaatgggacgtgtgtggggtgcattcttggagctggtgacccagagcttgggtttcctggagcatctcctggggctcaagctccacagatttccctgggatccactgagccagagaggatcgaacagtgcctgccactgctgggggacccactgggattgcggtgtggggtgccccagttggactagggggcctgttttccagggaagattcagagcaggagttttagagggtgagggccccccgccctgccccgcccagctgcgttcattccggcaggttgaagctgtgggttgcctcaaacgtcttctcctcaggcctacagaaggctgccagacccccaaccacagccagccgctcggccctcacgttcaggcagctgctaaggcaggccggccggcactggcaccacctgcactgcacggagggctggggctggggctgggcgggtctgagtctcagagctctgccagtggcctggggtcttgctggggaaccagaagccacactccttgtggctggtgtccctggtgtccagcagacatgctctctgcagcccctgggctgggttctggtgcctgcaggcctcccaggccatgctcagccctgtcctgacctgccagctgtgcttcatcccttgggtgggggcaagtgtgccccacacagccagagctgtcccaaggcccagggccagccgcgtgggtggctgggtgtggctggctttcctgtgctgggcaggggcaggccgctcagaaatgtggctgccttgagggacagacagaccccttagccaagagaggggcctgtctggcatgactcggagtcaccgcctggggttttggggctggggcctgtgcaaggaactctttgcccccgtcccttccccaccctgtgcagatctcagagccggaagaggcctggccatggtgggaactcggcgtcggatggacacacctgtgacctccagccagggtcgggggaggctggccacaccccagcagcactggcccctggcctgggctgtccactgggccctggggcctgccttggggaggccaagtccgggcctggttctcctttggccagggccttggcgcagagtctgtccaccgtgccccctcctcccacaaaacctccccagagtcccttttgttgcccagcctgggagcttccgcgatcctgagtgctgctaggagggaacagaggccccctcgtccgtcctcccctctccccagcccatcagcaattcaatttgtgccgcaccggagggatggcattagtggagtcagagttaatatgatgtattgatgggttgatttccccccggcggctgcgtgctgggctctgcgggacatcgctcctgggctgcctgccggcttcttgcctccctggggtcagggcgagtgtgggccagggggctgggagttgcctctgcaactgggtctcttgcttctctagctccggggtaccccagattttcggggagtctggcatccaccttcctacccgtgagccacttggatcaccatggaaacagcaacgttctctatgggcagcaccgtttctatggaacccaaaaaggcaagtgcagcatgggaccggcgtggggagcaggcatgctggaggtggggagggggcgcaggagcttctggggcacaagggaaaggccagcctaggttagccctcccaccaggtgtcatcgaggccagggtgggggctagaggagagggtgggcctgcccctcaggatttaaacccaggggcccaggaccacccccaggcgcaggttcagttcccaggtcacgctgtctcaagacctctcactgctcaggtgggagcagctgagctggtgcccaccttcctcatcaccctagccccaccggcttcctcaggacctggccttgccctgcagcccccagcagcccggggatggtggggtggctcaggaggaggatgcatcctgtgggggctggaggaagcccacagaagcccgcacttcctggcttacacacccggtggcctcggctagacctgggctgcacgaggcccagcccccagcccccagccccccagccccgtgtcctggtggacagaggggctgctcaccccattggcagcaggcatccctgaagaagggatgcagactttgtctttgctgagaagtcagagccggtggggccttggggaagaggaagctcaggcccagcagagccgagtcctggtgccagcgagtcccctcagggtaccggagagggcctggctggaggtgggatgggtgtgggtccttatctccaagttgggtttcctctggtagggcgacatctcatttgcattttaaaaagttctccttggggtgacaccaggaggctggagcaggaagccatcggttagttaccaggttccagtgagaagcgatacaggtgtggggccccacaggggccggcatcggtgatatctaggagggagattgggggcagggagggatagaggggtctaggtggcccccggtttctggcctgggctatgggagggtgcacctggggagcagcagttggacggtggggtgagttctgcttcagtgcagaggggctggggcgtctccccaaggggatccgagaggtgtctggacacacggggtggggtcagtggggaggggtggactgggaggttgtcccgactgtggagagggacgcccaggctgtgggggatgagaagggaggtggggacagatggtttccgcacagctcctgggagcccgggagcccaggagccctggcgtttagggctggagctcagggtgggggcagaggagaggcccagaaaggcccccacagggcctgggaggcggactagacaccctgaagggaacagagggaggggaccccagtgagcctgtgctcatgagtggccatgatgaccccaactctgagtgtgagctgtggggtagggacccgaggccagtctgcccaccctctcttggctgcccctcagccccttctccccacctcatactcactccaggacctctgtgtggcctgcacttcctcgcctgcaggagcccgagatttgctaaggctcaggagggccttggccttgcccttgtcagccagctgcaggggagcaggcatgggggccaggaactcaccaccagccccacccaggggattcagctctcacccaggacaggcacccaaaccggtctcctcaccccacaccccagctcctgtggacgggctctgctgcccagaggacagccccgcaggccccgttcccctagaaccgcgtcagccccagcgcgtgcagttattttgacagtgtttgtcaggggcgggcaggtggcgggtcccaaccccagaaacccaacccctccaccagcacaggggactccctctgggcagtgggccggccaggcctctcggctttcacaatattttggtggagctgtgtccaagaacagtatttggttttggaaatggagctaattaggtttcgctggggctagccccttcccgctccccttcccccttgtttctaattagcaggaaattgacaaggaatttacatgcctgaggacaattttacaagttccaaatgtttcttttgtttctccccttgtcagctccctctgctcttggcaccaccctgctgcccacccacccagctgggtgtggagagggacagcacccccagggtccccagaggcggtggcctggccccctctgtggggcgatgggtaaccccagggcagccgggagtgtggagagcttggggcagaccctagccgggaagggagggcccagaccgagggcccaggctgggcaaccgtttcagggaccccagacactcaccccccaccaggcagggtgagcacagctgctgctctctgcccccggagccactggcctttctccatttcaacatattaccctagccccagcagcctgagacacccagatgagaggccgaggggctgggagctcccagggtgtccagcaggtgggtgagcccttcctccgcgacccacccgtccttcctcgcctctcctctgggggcgccaggagctgcgcctgccacctgtccctggtttccaaggtcttggtgcctgtttgtaaagacccagcagagatgctctgtaacactcactgcctgccccgcgtcccccgaaaatccactgcctgccccgcgtcccccgaaaatccccactggcactgggccaggcaggggagagactggcctcgggtttgcatctcccatctctgaggtgtggggagctgaacatgggggcagagggtgagtgtttcacggggacagaactgcggttcggggaggtgagaggttctggccatggatgctcgtgacggctgcacggcagggggagtgtgcccagtgcccctgaactgtgcaccaaaaatgggaaattttatgttacccatatttcactacaattttataaaaacaaaagcaaaaaccagcccggcgctgtggctcacgcctgtaatcccagtactttgggaggccaaggcgggtggatcacgaggtcaggagatcgagaccatcctggctaacatggtgaaaccccgtctctactaaaaatacaaaaagttagctgggcctggtggcgggctcctgtagtcccagctactcgggaggctgagacaggagaatggcgtgaacccgggaggtggagcttgcagtgagccgaggtcacgccacagcactgcagcctgggcgacagagggcagagcgagactccgtctcaaaaaaaaaaaaaaaaaaaaaagagcaaaaaccttccctaggctgtaacctggagtcagtgccagctggtgtccgggaggcacctggagcacctgtctcagggagtctttctccagcctcacccctaaggcctcccattgaccttggctctttcccacacagataacttctacctgcgcaacctgccgccccagcccacgctgctgccggccaaccacaacttccccagcgtggcccgggccgcccctgcccaccccatgggctcctgcagccgggatcgagaccggggtgaggcaggctccctgcagaagggccccaaggacttcgaccgcttcctcgtgggcaaagagctgggcagagagaaggcgggcaaggccgctgagggcaaggagcggccagcggcagaggaggacggtggcaaggagcggcacaagctggtgctgcccgtgccagccgacgggcactgcagggagggcggccccgcaccccgaggggcctgcgagggccgccccaagcacctcacctcctgcctcctcaacaccaaggtgctcaacggcgagatgggcagggctgcgctagccagctgtgcagggggcatgctggggcggcctggcacgggggtggtgacctccgggcgctgtgcaaaggaggcagcaggccccccggagcccgggccggccttcagcgagtgcctggagcggcggcagatgctacaccacaccgcatcctacgccgggccacccccgcccctcagcacagccgccggctccttcccctgcctgcagctgcacgggggccctgacgggctctgcccgctgcaggacaaagccccccgggacctaaaggccagcgggcccaccttcgtgccttctgtgggacacctggccgacaagggccgccccttccaggccgccgaggcctgtgccgtggcaggggagggcaaggaccggcacctggagggaaccatggcccccgaccacgctgcaccctatggagtctcctatgcccacctgaaggccgagggcaagggcgagcggcggcctgggggctttgaggcggccctcaacccccggctaaagggcctcgactatctcagcagcgcaggccccgaggcctccttccccggactccctaaaagcggtctggacaaaagcggctacttcgagttgcccacctcttcacaggactgtgcccggcctggtcaccaggacccgctgggcgggaaggccccccaggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtacaggccctgcacagagagggaggcaggccgggacagtctagggggcccagctggccctgccctgcgccccggctccccagctcccacacctgcccttggcagaccctccgaggccccaggaccaggggatcctcctcagtgcatcaggccccccagctcgaagcggggtcactgcttgccttagctggtggctccctggccgccccaaccctctcccgtctgctgtctcgaccctgtgcaggtggcggtgggccccgttccacacacgcgctggacctggaggctgaggaggagaggacgaggctatgtgatgaccgcctggggcttgccagccgcgagctgctgctgcagtgagagctgggcctgtggccctggagagtggggctaggcctgggcttggggctccccactcagagccacgtggagaaagaggggtggtcatggctggggcagcagattctatggccggccgtgggtggggttctccccacccctagagcctttctggagtctcacccggggttgggggtctcagttaaccccttgcagcggtcaggttacccactttcaggggccaggagatggcccccagtcagccctgcagagcactgaggctggagcctggggttttccctgagcctccaggtcccgttctccctcccaggttgatggcagggggtgggacagggagtcaggcattggcaccgttggtggggctgagccccaggtcttacagagacaacaaagggccgggggtgggatggggagctgggccttggcgccggcggcagggctgagccccaggtcttacagggacagcaaagaccgcgtagagttcgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggtcagtgatccaagggcgggggctggcctggggctgatgagggttccctcctggtccccgagagtgcgaggcctgaccactgtgccctctgcctcccaggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttggtaagggcccctggtccaggctgctgtacttggggggtgctgttggaaggaggggcagccgggggtgtgctggccagggctcaggagggagcggtgggcttggtgggctgaggaaagggtggcggggaagcagccccggagctgtcccctccccagccaggctgacccctcctgggccctgcccacagcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccaggtaccgcccctagccacgctcacctgggccgggcacttctccccaaccctgcctggccggacctggctccaggagacccctgcatgcctggcctctggcaggatgaacccaagcagggggcccactggggtcaggggatcctgagcctgaccgagcttgcccccatccctgacagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccaggtgagagtagccgcctggcccggcccactgtgctccgctccaagccctcccacccctgcccggcagggctgcgctgaatccgggctgcctgcagggaggcgccacacctgcccagacccagggcagcatggctgttcccttcctctctcttccctcttcccagtcctcccaatgaccttgggagaagcacacagtgccccagccgcccccttcctggccgtgggctgacgaaggcgggaggaagacggggtcccgctggctgtcgtaggggccctccagcaatgaaggcggggcctgctggtggtggtactggcaccctgggggcactgggcatgggacttgaccaggctgccattcagggtctcagcaaagctgggagagggaggggcagcgaggcggggtgcctgggtgggggggtctcgggcctggcctcggcccctgccacccgcccatccactccccaccagcctatttgattctctctgagtgggactgagaggtcacactggaaaccgtgtggcgaacataaaacccgtcctagtttcacagtcaggagatggagctagcagagggtttttccgtttttttcccttcgttttttttttcttttttttgcagttaatgggacatgatgcctctgacatgctgccggcttgttctggttcagggaaaaccctgattaaagcatcatgttttacaaattcccccttttctggttacccacagcataccatgccagagatggctcctgaggccacccccagccccggcagccagggttgttggggggagcttcaaggccactctttaggggaatgagggcctggcctcaggctgctcacaccttttttttttttttttttttttttttttttttttttttgagacagggtatctccctatgtcgcccagtctggagtgcagtgacgcgaacatggttcactgcagcctcggcctcctgggctcaagccatcctcccacctcagcctcctgtgtagcttggaccacaggcatgcaccaccacgcccagctcattgttctttaatttttttgtagtggcacgtgctcactctgttgcccacgctggtctcgaattcctggcctcaaatgatccatccacctcagcctcccaaagttttgggattacaggtgtgagctactgcacccagccaggttgcccccttaattaacgtaaccctttccccgccaccagtcttgcagacctgcagctagcccagggcccttccgcacgggcttgggtctgagggttcgaggccactgtcctccgtcctatcgcaggacaccccctcaccaccactcccagctccctgctgacctgtcccctcctttgcagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctaccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccaggtaagcccggtggttgccgccaccccccagagtcccagcagtgggacccacacgcctgcctcagggtcacctggccagacggcagccttgggccccgctcagttgtccccaaagtgtggtaggtcccctggagagtgtccgcctccccttgccgtccctcgtccatggaagtccgaggcaggtgtgccatctccgaatctctccgtcccaggtggggccctgggagcaggactaacctccatggtggtctcagaggaagggcctctcgggcagcacctcctgttggaagtggctgaacaggggctcgcgtcctggcaaggggagaggagagcctgccgcctgcctcctgctctgccaggcctccacctcctcagcctccacggctgctaccctggcctggggggtccagttcaggaaccgtcggctccccgcttcaggcccaggggagggggcaggaggctggggctcctgctgcagggaggcctatgggactgggagctcctgggctcttccgcccacccaggggccccaaggacagccggacaacagtgggcgggtccagagcacctgggacacccgagggccaggtgtctgcttcgtccaccctgggccttggtccgggcactccctgcggtccagtgctcccgggaaagcgcccgcttcctgccgtcttccctgtgggccccagagaaagccccggggtggagggcgtcccccagccgggcacggcgccgtggttgttgatagcacgaagctgacagtcttcagggctcggccgctgctttctggatgcataaagctcaccaccgcgatgaagagaatgttctcgaacagtgcatttccccaggggcccgtggtcaccctgtgctggatgaggctgctggcccgcacgcggcaggggtggttccgcagtgctgggagctgcctgccctcgggggtatctggcccagagtccctgcttctgggtggggctgtgcagagggtttgaggaagcttggagtcctaccagggtgggctccacctggaccccccagaggccctcccttgggcctccagctggcaatatatgagaagttagatagggcgaggtggaggcaccttggggcagggcctgagctgccagggacccgccgtgggagggtctcagggaccctcacctggcagcatgaggaggcgtcagtagatagcaggtcccgtgtgtatggccagagtggccggtctgcctgtgtgaatgcctgcaggacaggagcccgttcactgcatgaatactcatgtgtagaccacgtgtcccgggtggtgggccatgtggcttaacccagcatggatgtcgtcacactccggccaggccaggtgtcccaatccccagggtgtgcagaagtggagtcagggccagctctgccctccgggtctccacctcatggtccccccctgggcccccacccctgcccctgccctccccttgtccccgttaatgggcaggtctctgcagctgctgggctcagagctgatccctacaagtgtagcgatcacttcaattgaaattaattaggaggttggttttgtcctgtgccagacagcaagatttgcagagggggaagtggagaaaaagcccccaccatcggggccgggcaagcatagagcccccaggactggcagaaccatctgggtgaggccacgtgggagccacacgcctgtagcctgcaagggcaggggaggcacagaggggcttctggccaactgcagtgaccccaggagacctggggccttcagtggaaggggcctgcagatgtgcctccccggctgctgatggcagcagctgctcagcccaccccccctcggccctctctccccctcccattccctgcggatcctggacccagcagcctgagtgttcccttggtccccatcagatctgtggtctcggtccagagctttgcaccccagcatctgcccctccgagcacctcctggcttcttagtaatgacttctggggatggatcaacccttggtctgggcttgtggccccctggccctccccatacttgaggagggaagcagccacgcaccatggagtgccccagcctgggcgctcaggtcagtgcctttggtggaatctcaggtgcgtgccccagctgtcaggcgctgatttgtcccatcgtggatggggttctcccgcactcctgcttctggctgagatgagccatatctctggggagccccggtccgttaagtggagcgtggggttctgaggcagagactaggtttggggtgctcgttgctgtgaggttatcgttgctcctgggctttcccaggggataccagcacctctactcaccccacaggggttccgcagttctcctgccttcctggccatcaccacccacccccaccgcaaggtgtctggctcctgtctcctgctggatgtccttgtgggatcagcccatggggaccccgttcctggtctctgtggtcagccctcagggctggcttcccctactcaggccctgagtccccaacctgggcccgaccctgcatggacgccagcctctgctggcccatgctctgaccccaagatgggccatcccttccccaggccactgcctgggctgttgggctgccgctgttcctgcggtcactgtgagggtagctcccctgtccctgcccccaggttgaggtcccagaggatgcggccctggcagccccttcctcctgacctgtgttcagcccatggccctcctgcctgccccagggctggagcgtgctggaaagggcttggcagagcccagcactgtgttcagagaccgggcaggggcagggatttggtgctctgagggaggatggaggaatggtggctgctcctctgagaagggtcacagcagatgagactgcatccagaaacccctgcccgctgccctcctcacaaggaatcgagggcctggggtcccagctacccaggaagctgaggtgggagggtactggagcccaggagttcgaggttgcagtgagccgtgatggagccaccacactccagcccaggcaataaagcgagaccctgtctcaaatttaaaggtatcgaggggacttgtcccctccctctgcactgaccactggcctccctgcagccattgctctttaggtgtccacacaggcgagtggacggaaggactgatgggcagatggacaggcaatggcaggtcttagctgctgggggacgccagcctccaccacctggatggagtgatgcccaggtgctgaagcccctggttccaaagccatctctccgcgtgactttgaacttggttgaagccacgtagacagacgcctgttggaaccgcaggcttgagccacagcattcaactcggttgaacttcagcagcttccgtgcacgaggcctcagtgggctctcgtagcactgcctgtgtctctgagggccccagagtatcccttcccagggctgccgttcgaagcagggcccccccggtggggggacacacaggcgtttctgttagaagctgtaacgagcagattgcttttacttcgatgctttggggcctgtcttgctctgtgacacagaggaccctgccccgtgggtcctcccagctggccctgccttaccaccaagggagtgtctccccagcatgcagcaaaacaggggtgctgggtgtcagccctggtgcccacctcactcttcccggtctcctgaccctcatcccggtcttcaaggctgggtggcttcagggggccagggctgacatcaagagcctgtgaggggcagtgtgtgcccagttatgcccatgctgaccttcccatgccgcacagaggaggaagaggacgtgctagccttcaacctgcagcacctggccacgctggccacagcctggtccctggtggaggccgctggcctggacagctccactgccccagcgcagccgcccacagccaacccctgcagcggccccaggctcaccccccgcatgcagatcctgcagcgcaaggacacctggacccccaagaccaagcctgtgagtggaggtcccagtgcccacgtcgcccagtgcgttgccacagagccccagcctgggccctggcccggctcacaggcccctgtgccccccccaccaggtgtgccccctgaaggccgccatcgaccggctggacacgcaggaggtggggatgcgcgtgcggctggcggagctgcagcggcgctacaaggagaagcagcgggagctggcccgcctgcagcgcaagcacgaccatgagtacgcctggcgtggcgggggggcctgggagggtcgcagcacccccacccccgggaggcgcccacagtgctggggccgatgtgggaacaggccaggattgggctctgccccctacctgtgggcagacaccagggtccatcggggaggccccccagaggcagtggggcccaaggagggaggcattcggccagcagcgagaccaagtggcagggccaggggtctgtggaagagccgcttgtcagagcctggtgtggcaggaggctggccgcagggtggcgggtgaggggacagtggcagaagggggagtagggaggactgggggtgctgtggggccagggcagaagttgggggattctctgggggaggggacaccccgcagttgcaacaagggcaggggcaccacctgaccagtgtgtgtggatggtaggaggtgggggcggcgggggcccctggctggccttgccctctgcgtgaggggtcaggctccccaggccgagtctgggccgcatctttccccacacccagtagccctcgaaggccaatgccctcggctggaaccttgtcggggagctgggttgtgcatgagcctctgaccatcccccctgcggcccccaggagagacgagagttcacggagccctgcacggcgggggcctggccggccgaggaagcgcaaacactcaagctcgctgcctgccccacgtcccacggggccgctccccaggagcgatggcaagaaagtcaagtgagtcctgggcactggcatggcagggcgcgtgtggccggccctgggccctcgaggctggggagcagggtccaggctcccctgaggcttccaggctgctggtgccccttcacacctactctgaaggcctggccctgcccttcctagaccatcgagagtgaccagcagacagagccctgctccagacaggctttgcccttctggcagctcccagcaccaccctggcccgggtccccctctggaagtcacggcccccaggcccagccacgccggctctgcacacctggctgtggcatcgtccccgcccggcccccctggagtgtgaggcggtgttgcgtgcaggcctctttatctgcactgtataaagtcgttggtcacgctgtggagctgctcacggctgccggcgcgatgttattatccattacccgcccggcgcagtcgttggcgcactcccgggcctggtataattgtccttctcggctacaaattgcctctcccggcaggcccatttgcataaatcctccgagctcctccaaacacgattggcgcgtgcgtgtgcgcactgcatcaatcctgatgatttggtaataatagttaaatcggcactaaatggttccttcaattaagacaggcaaaaaattaatctcagggcttcatgtcacaaaacattagcaaatgcagagaaggttacggggaggggctgtgtggctgtgggcagtggaggggtcaccatatggctgcccccccccagagctgcccctgccctgcccaggtgtctcctgggggggggtctcctggggtctccctttgagaaccagccagcactgtgggaactgctgggcaggacagggcccctggaaaccaggatctggctagaaggcagcagcctcaggacagggagggaaactgagtccaggacccctcttcccgagggtcagggccccacctcacccttccacctcctgccctcactcatccaggcagtggtggcagaggcagttggccccgggacgggccttctaccatgcaggaagtcggggagcgggggcccaggggtgccttgtggcccatggcttcctgcctggcccctcaggcctcagaagcccagcctcctctgtgagcaggaaggtggaaagggacatccggccacgccaggccagggccaggcagggctctttgtctccatctgggattcattttcatgagcagctgggtatccctttgcacctgtgggcaggtgggggttgaaaggtgagaggccaagcccccagcccctgtctagccaagaacaggcagagagactccccaagccttggcttctccatgtgaaatggggcagtgggaggttctggggagggtgggtcacccacacaagagggggagcccaggatgtggggggatcaggtgggacctgttttggggcatctggaggtagctgctgggcccatgtaggctggagttgacttctgccccagctcccagcctgggggacagcacagctctggggcatggggaatactgaggctcagcctccgcagtgtccagggctccatctgggaggggccagggatgcagaattccatccttaagacccgcgtggaggacagaatgggctcctgagagggcctgagcccggcaacggggtccctggggactcaggggaaagcccaggcttctctggacaccgcccccaccccaccccacccacctgcccctacccccgcccctggtgggactccggttggcacgtcctcttccagctgtggcggaaatgtgggtgcagttctcacaaacctgcccggtgcctgccccactcctaagggtggtagtatcaggccctgaacacccgccaagggccgggcccggcctgcataagccctgccccagactcagacaggcacatgtgtggctgtcccttgttccaggtgccaaggctggggctgcagccccactcaggccccagtagcagcagagccctggctcctgagcactgggcggcccctcagagccctcaccggccccagcccccgacacctggcctctgggtcactgtggctaggaccagacagcactgccagggcgttccttcctatcaggctggaaggatgggatttgggtaacagaagcgtgcccacttccagtatagccaagtgggggatggggcggatttgaggatatagggactgctgagggccggtggttggcaggcagaggggctggctgcaggcaggtgctcagaggaggtcagagctggctcggcccccggggcccctcaccccctgctctgtctgcccgagacgtggggcccttggaggagggtgacccacagtgtgacccactacagagacagtagggggacaaggctggggcggccgggcctgcatctgccctgcacccaccaccccatgcccccagggcggtgcggacaagcctgggtctgctgtgtgcggagctgcgaggaggcagtgggggcgagcctgcgaagaagcgaagcaagctggagaggagcgtctatgcgggcctgcagactgcctccgtggtgagtgccgaggcgcccgccttgccccagggcccttcaggtcccttcaggtcccttcctggcaggtagcagactctccccagccctgtgccgaaacccattgctcagatgagcgaagcaaggctggggagctccgagcgccgacagcaggaggaggagggtgaccctgcggtgtaacacaggaaggtctgaccgggtggccctgccgccacttgcccacgtcactccaccctcctcgtctcactccagcaggaaagcaaatgcccaggctacactctgctcacagagactccctggaacgaggccctgcctttcttcaggtggcccagggcacacttggtgtggcgggggctcctccggctgccggcaccccctttcttcttggtgtgggggggctccccacgctgctggcaccctgtttcttcttggcgtggtgggggctctctcggctgccgacaccccttctttcttggcacaacagctgcctcctgcccctcctctctccgtggcctcggcggggctggtgagacgtgggccccagcatacttcacctgtctgcccagggggctgatccttctgcccagatgctgttttatccctccctttagaaaagctaacagcctggccccacaacccacagccactgggccctcagcctcctccatgtcccctacgtggggtgggcagttggtgggcagtgggttgtgtgggaaaggccgcagcgtaggctccaggggcaggccctgtgtctctgggccagacatcccttcagcccctgtggatcgagggcaggggcctcgaggtaccagttctgagccgggcatcaacagagaggcacctaaccgcccaggggctgtggtttgcagagggcgccctgagagtgcagctgcccctccctgttcacaggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcaagttgctggcgtgagtggccactgccaggagccccggtcatggtcgctcgggggctggaggagggggcggcaggttcatggccgccaccagggctgggtcatggcttgtggggtgtgacaggtccaaggagacgttttcactgaacaggctggggaaggagatgaaggtctcacggaaggagacccccatccccaggcagagctcagtggctcagcatgcctcacccccatgtcagggccgaaggggaaggaaggacccccactggaagcatccaggttaaaaatagccctctcaacggccccagcccctgtgactgtagcatccggctgagctgaccctgaggcgttatctgaccaccccccccagcaaacacgtgtgtccagaaacaggagcctagaaaaatagaagcttcctttcttctgccagccccttcccccaaggtctcagatgcctgagaaagaacaaagggagggccgcttggggctgggggaggggcagagggccatctgggcggaggacagcagaaaaaggggaagggactttctggggagggggccccagccctgcctggtgggtgccctattgcccagggtataagaaaaaaacacccctccccacacccatacaaatcccttcaggctggaggccaggacctcaggcacctgcccccaaagcagccccacagagcggcccagagggtgacggtgaccagctccactcacagccccgccataaccgcatgcccagagggtcacctcccccacctctcaatggcacagcttaccatcaagtcatcaggacccctctgcctctctcccaggcagtggctatgacagtgaggactgcgagggtctcctggggacagaggcaccacccagggaagcagggctgctgctgcacaccggggccagtgtggccgtgctggggccctcaccctcctctgtggtcaagatggaggccaaccagaaggccaagaagaagaaggagaggcaggggttgctaggtaaccaggagggaggacaggggttgctaggtaaccaggagggagggcagggattgctagataaccaggagggagggcaggggttgctgggtaaccaggagggagggcagggtttgctgggtaaccaggagggagggcaggggttgctgggtaaccaggaggaagggcaggggttgctgggtaatcaggagggggagggcaggggttgctgggtaaccggggggagggcaggggttgctgggtaaccaggagggggagggcaggggttgttgggtaaccggggggagggcaggggttgctaggtaaccaggagggagggcaggggttgctgggtaaccaggagggagggcaggggttgctgggtaaccggggggagggcaggggttgctgggtaaccaggagggagggcaggggttgctgggtaaccaggagggggagggcagaggttgctgggtaacccgggggcgggcaggggttgctaggtaaccaggagggaggaccggcacagtcagcccaaccagccgggtctctaggatggggacccctgtgacggcctcctctccttcccacaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcgggtgaggctgggctctggggtgctgggcggagagggtgggtgcctgtgaggaaaggccttccccgccctcccccgcacgctggcccctgagctctgggtcaacctgaggctgtcccacccttgactcagccccttctctgcctgcccacgcgcagcggaagaacggggccctgtccatcacgctggccacacgcaacgccaaggccatcctggggaagggccggaagctgagcaaggtgaagcacaaggccggcaagcaggtagcagccccccactctgggagcccactgtgcacccacctgcaccccgcctgcaccccacccaagcctgactcctctggcccccagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctaggtgagcagggccaggaagggtgccagccgcctggggaggggtggtgggtaggccgtgccggccgctgacaccttgtgcccacagcgcgctcgtgtgccatccacaaggaggacctgcgggacgggctgcccgtgctcatccccaaggaggatagcctgctgtacgcgggcagcgtcaggaccctgcagccacccgacatgtgaggcctgggcatggtggggcagggcaggggcctggagggcaaccgagacccgtggcacctcacattccccaatgcccccagctatagcatcgtcatcgagggcgagaggggcaaccggcagaggatctactcactggagcagctgctgcaggaagcggtgaggaccgggccggcccgccccggggaggggcctggctggcttgtcccaggacaaaggaaggccttggcctgggccgcagccactcccaggcccagggaccagactctcaggcagccctgggccaggccccacctgctcatgggtcgtcgcccgcgttcctgcaggttctcgatgtgcggccacagtccagccggtacctcccgcccggcacgcgggtctgcgcctactggagtcagaagtctcgatgtctgtacccgggcaacgtggtccggggtaagttgcacccaaagcgggggctggggcaggcccctctgagacccacaggctcatatctgcccccaacagcctggcttccgaggctggcgagggcagaaccagctctctgcttagacagagtacgacaataaaatgagctccccaggcgccatgaaaaagcacagggtgtgtggggagggagggtgggggctccggcctccagccaagcagagagggcccagcaggaaggggccctgagcactgctgctgggggtcacagagtacgtcagggggcaccagctcccctgggcaaaacctcctgactacaggcaggggcatgtaggtccctagggcgaaaggctcaagggtcccacaggcaagtggccaggtgggcgggaggcgcctccaggcgggactcggctgggaggtgggcacgtgggcgtcagcacgtgtggggaggtctggttctgggctgggtggggtgacggtggcatcacatgggaggcactgcaggaggtggagaggaggcccccgctcctgggctgcagggcggctccactgtctgtgtggtcagggagcagaaccccagagccctcccctcaccctccccaccggctttggcagccccgcctccctgtttcgggcgcctactgggggttccagctgcaagctcaggtgtgccgtccacaggggcctccggtgacgaagatgaggacctggactcagtagtggtggaatttgacgatggggatacaggccacatcgccgtctccaacgtcaggctgctgccccctgacttcaagatccagtgtgagcctgggagctgcacggggcagggccctgcctgggctccactgtgtccagacgggctcccaaggaagggttggggtggcagtcaccccacagccatggcactgaagcccttggcccatgctatccacaggcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtattttaccggacttcccagaatccggatcggggaaggcaccctctgggggctgggggaaccaggaggcccgtggggtaggcagggtccggggaggggcaggtggaggcagctttgtgggcccagctggggctgactctgctgggcttttgccctcaggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacaggtaggtccagcgggaggcgggaggagctcctggttcccaaggaaaccggggcgggctcatgcgcccctgctgcccttccctctcctttttcatcttcctacttgatttcaagttaaaaaatgtggaaaactcaagggaagaacaaagacccatccatgacccagtgaggcagccgcttccgctggcccctcgctggagcccgtggcctgcgtgacagtagaaatggcttcatgtcgggccgggcctgagctgcactccgcatggtgtggcctcacttttccacgttgataagtggcgtggccagctggagagctgtgtatccccgcactcagatgcctgcgtctgtcctcaccagggcactgctcgggggcgcatgtggggccactcgtgggtcttttgccttcgtaaataacactgtggtgaacgtcttgtccacatgtccctgtcccagatccagtgtccagacgtcatgattccatgtgcgggctccgtggaggcgtggcccctgctccagatccatggctgccatggccttaagccgcggtgctgcggcttcctgcccttgtgggcgccctgcacactcacactcagactcacactcacacccacaccacaccctccatgcctcctggccgccacctgtccccacagccccccggcctctcagagccaccctgcccatgtcccccacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaaggtgaggcccggacaggtgtggggcccagcccccctcggggccccagggaggggacacgacagcagccagcactgtgccccaacacggagcacctggccccaccacacagcccccgctcagcaggtaccacggccctgcagggagccgcacagcccatgggcatgccctagagcagggctcccaggtccctccccacagtggggggctgtggcccacagcagtgctcagcatccggcaggtctagttcactcctgggatgtgtggcggcccccaccccgtgggccctccctgcctccagtgccagcctgagacagaaattgcactcagcacaccctctgctcctctctgagaagaagccattttccagaccatatgacacgtccatctttcagggaaattagtatttctctgactccgacagcccccagagggtccccggcaggttcctcggcctctggacagacagggctgcctggacctggtccctggcaggttcctcggccccgtcttccggccacacagaagtccatccggtgacccttacagagcatgggtgggcgggtggtctttcctggctgggcaggggcgcactggccaaggccggccactgatgccccgcgcgccttgcccccagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgcccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgccccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagggaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgtaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttctttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggttttcggtggtccagggtcctgtgtcccacggtactcctgggggttccccagggctccgggggctcagcagaagcctctcgttcccagagctggggcttctgggccaggcctccccaccgccccctgtgttggcccaagtgaagcccctcaggccaggaaagggtcatgtgaccggaatgggctcagagtggtcttaggggtggggtccctccaggaggagggcccctttcctggttgctctcacagtccctgtccagcctgaaccagtccagggccagagtaggttccactggagaggacgaagggcaagagcagtctccgagccgccacgctgggcagggtctcagacgtgaatgaccatcctgggaggggcggcccacggcccgggtgtgggaacacagatgagtgcacccccagctggagagagccctgttcatgaggctgcagacccagaggaagccggatgcttgcagggggtaggggaccctccttgttccccctctgccgccgggatcttgggaagctgcatgaagtcggtgcacatctgtcccagtgggccctgagtgcctggtcacagctgcgtccaaggccaggaaacatggtccttggaggacggagtccctgagtcagcagtgccttcctgggccggtgagtgcggagagaggtgctcagggaccggccgtgcctcaggctgctgtgagggcagggagcagatgaggccctggccgggccgagcgctgagtaagggggctgctggaccaggtttctgggtcaggggtcctctgtggcaagaaaggaaagacgggtgaggccagacactccctgtgggctcaggagaccctgacttcagtgatctcagtgacttttttcgggcagaatccagcccggaacagggaggaaggcctgcggctgttgccccggttcctggagccctgagccaggacttgctgccgcctcctgcccactccaggagcttgcctgacggagcaggtcgcacggagaggccacaggcagccgacagggactctggggcaagagagccggatgaggcccaggccggagaggtgacacctgcctgggaagcccacaggaaacctctgccagcaggtctcaggttcaaatcctccattcacccagcactgcctggtgccagcagtgtaccaagcagtgagccacagtggaagtgagcggcccacggccccaccttcatgacaggcagatgggagagaccagaacagtggggcccagcagctgcacccggggccacgcagctgagataacctcacccgtggaaccccaaggtcggccacccccatctcagccaaaagtgtggtatcggggctgagccaggcctggtggggcagcactgtggctccccgccccccgctgcatgtggcagcaggatcagcggggacttccgcacctggcaaagcagacaaagaactgactgtccctggggtggtccaggtgggctccctggaagaagtaacacctgggctgtcttggaaaagcccagggcagggcagggcagacagagggtagtcaaggaacagctggggtggccagcaggtggttaatgggggcggggggaggtaggggattgatgttagagctagagggtgacagaggccaaatctcaagcccctgagagcagcatggagcctgtcttctctctctgacaatgggtgccccaagggctctaagcagagtctgcagtcaaattgaggcactggttctgcagcctgggagtcagggttgaaggtcccaggccagccaggcacctgggggtcagggttagaggggccaggtcaactagacacctgagggcccaggccggcacaggtacctggggggaggggctggcaccaagagaaaggctttaagggtggcacagggccggactaggggtccaggtggggctgagggccggaaacggccagaggggagggggcctggctgaagggggtgccaccagtgagcccaggaggcaggtgacccgggcttagcgagtggggttgacggcaggcttaggtgggcccccgacctcgagggtctgacctccccaggagccctgcagggcacactgctgaatctaagggcaggactcacgcctggctctggccccgcaacaccgccgtcctactctccccctccatcacctctctgcccctcgtcctcccaccttatctcagacagggccatccttgccttccagaactgcctgcccccagaacaggccctgggcaaagggcagggcgttgtgggaaggacagtcagtggggctgggcatgcacagctgcggagccccaagggttaaacatgcaagactacactttgatcaagacaaacgggccattatgtgaaatgctggagcaagatgaatgctggcgctgggtgagtgagatcaataaaagtgatgttttatcaggtagaaatgacaacctggctgatcgcaattcgtttttaataccacaaaccaactggggaccagggggctttaattgttcatccccggcctggcgaggttgctgggggttggcggggagtgggggagaggcagccgcaccgctcagccgccgcggggtcaccgggcactggagctggccggacgcccatgctgggtgggcccctcaatggtctcctgagtctgtaccaggcagggtgaggagggaaccgcctctggcccctgggtgcgggctaagaaaacaagcagaggcagcaccccaggggaataactctgaacggccccatctcccgccaagcccctaccaggaacctgggcccctcggcctccactctccccccaacagccaccctttcccgctccccagaagtcccagtgagaagccagcacctccctcctttaagagccagaggacccagccttgagcttcccgtgccctccctatcggtgcagcctctgtaacccgccttaggctacctggagccataatggtgacgaggacgcgtctaggggagcgagcttcccacggacgggcgggtgggttgttcaaggcccaaccaccactcagtgcccacctgggaccacagcacagctgccagggggaccaggcctgcccctgcctcaggtggggagctgggccgggcaacgggtcagtggggtagaggtgcggccccggggccaggcctgcaggtgcagcctgactttgcagtggctcggacctcagtgtccgtgtctgtgaaatacagaccttgagtctctttccccacctataagaccaggatgaggctcacaggtggcccaagggatttctggatggatgcacaggcagagcccagtcagcatgggggtctcagcccctttcccttggcctacaacctcaagccccaggccttgtgtccccacccacacccaagggaggcttgagaggcccagttcaggcagaaagaggagcagggctggcctccaagcctccgctctgtcagtgtctcgtcacagagatcaggtccgcagtcaacgcttttgggccacttacatcacttccgaaggccagacacacttccgcttccattcagccccctggactcctgagggcctgagcaaaggcctcccaaagcaggaagaagcagcagaccaagagcagacactaaggctgggcacggtggctcaggcctgttatcccagcatgggaggccgaggcgggtggatcacaaggtcagatcgagaccatcctggctaacatggtgaaaccccgtctctacttaaaatacaaaattagccaggcgtggtggtgcatgcctgtaatcccagctacttgggaggctgaggcaggagaatcgcctgaacccgggaggcagagtttgcagtgagctgagatctcgccattgcactccagcctgggcagtaagagcgaaactctgtctcagaaaaaaaaaaaagaccagacatggacagccgccactcggagcccagagcagggtttgccatgagtatgccacatggtctcgggcctgatgtcgctgcggaactgggaaaagcatctgttttcttacattccacatccctctggtgtcttttgctcctttcctttgctgagactgagttctcaggcaggctctatcctgtgctttagagtagcggggcccactctgatgggcgtttcctgtctgttttttggaggttcccgagactgactgcacccatttacagaaaggaaaggcaggggattgacacagcaccctaggcttcctgggccaacacctactgttcagggaaaatctccagtcctgtctccctggacagagaggacagcagggtccctcacgatacccagggctggtggggaaactcaacacctccagcctatcccagatatcctagaatctgtcatcctgccagaataggcctgtgatgtccctgtcccatcaaagcaggggacagtgcatgctggttctcaacccctgatgacgtgatctgttcttggcaaggccacttcttgtttccttctctgacaaccattcctgtgtccatctgcccatccatctgtccgtcacttcaacaagtattaatacaaactcaagacctactgtgtgccaggcaccaggatgcagtgttgagaagattacacaaagcccacacccccaagaaactcagagcccagtagggaagaaggccagcacacagaagccctggcacccagcacaccaggaactccgagaagccacacgaagggtacaggacagggcccttcctcagtacagagcagctgcaagccaaagaagctggctccaggcccccagggagaggagcagtcctgctgcccttccaggaagctcagcccctagtagaatgcacttctggggggcatccacagttgcttcctttaactagtttaatccgaagacaaaagttgagctaaggcagcttgcagagaaaggaaggactagaggcttgctaggtaggactcgtcttccactggcgtcacctcagaaaacagtgactcagagaacagcctctaggcctgggccctcagccccagggcagactggctagcaggccagtgggaactctggtctcactgaggctggggctaggggctgggacttcactgagaaaaagtgttccagatggcagtggggtgggttaaaccagacgcctcccagagcccctctcccctaaggttcccagcagtcaggagcctcaggctctcaaacccttcctgcggtgacggaatggtctagaagcctactcacaatttggtttgctgagagggaaaagttaaaaccgccctttttatttgggagcctttgaacaagtttatgatcttgccccttgtcaggaaatctgttttcacttacaagaaacaggctggctcaggggccggcggtgagcagagcagtgagggaagactccacactgacaggctaattatatttttcaccactggcccggttagtccccactctggtcctgggcaaagcacccctggcctggtgctcctggaagcccccactacggcccgtctttttggggggtggagttggaaagccaatctacagcgagggtgcagaaggccagaggtgatgtcggggggcccggacaggaaggggacgagcgcccactgctgcgcaaccagagcccaggcagcctctgctctcggctgtgagcactgtggagcagccggggattctgaaggatcagcaggcaaacagtgctgcccccagacacgcagggctccgaaaagccaaagccctcagagggtgtccgaggccactgtcccagggccccagaagctgcaggaagagcctcctctggggcagagacacgccatgcacgcacgtggatccgaggacagccatgccactctccggtcacatgacccacgccaggccaatcacaacacctctgcttcctctgccaccgtgattggctttgggtcgggcatgtgacataagctgagccaatcagagttcaccactgggacccaatgagcgcacagcttttcctgcggcctcctgcagctaacccgccacgttctcttctcccagcgctgggctctcgccgcggcagaacttcggagtccaggatggggttgtagagcctgaggtgtcattcacattgctggtgaagaacaagtaatttgtaacaaaagcatgttccatgcaatatcaggggtatgcttatactaaaaattattcattctttatctgaaatttaaattaacctgacgtcctgttttatttgtttagagacagagagggtttcgctctgtcgcccaggatggggtgcagtggtgggatcttggctcactgcagcctccacctcctgggctcaagccatcctcccacctcagcctcccaagtagctgggattacaggcacgtgccaagcccagctaattttttaattttatttttttgtagagtttggcgggggagggtctcgctattttgcccaggctagcctcgaaccctggattcagcctcccagagtgctggtattacaggcatgagccccgcacccagctttgtattttattcattaaatctggcagcccgccttcacaacggcggttgaccttgaaagccagctgtccaacataaagtgggtctccccagcccacctggctgcacgcagctgcacccagtcatccatcacggggcagaaagagcccatgcaggcccttaaggctcaggaagctgctggaggccactcctgctacactgaccctccctcacctcaaacccatggcctctgcgaagcctcatcacctgttgaccgaggaggcagcagcctcctttacagagccagccccagccccaagtggatggctgcaccctcacagccccaccttgcaggacaaccctcccagagtgcagcacattgagtggacgtctccatgttcaaggccgaggcctacagagtcctgggcagtgcctgggcatctggccaaacgtgagggacttggaaaaaacacagggcaaaccagtcggggacaggagttggaggagttcgaggaagaggagggtcagcaggcatttgggctgtggctggaggctgagcatgtgtaggcccgtgtgagcccaccagaagccccactgcagaagagtttttcagagtcaggtgggcacatgacccacccgggggtgcccatcacctccctcccccccagccaatctgcagctcaccccacgggctcgcagtgtgcagagaggaaggtcaagcacaggcactccctcttgaaacggccctccctgtggctggtctggattcccactgaggaaggctcaattgtagaagccacaacggacctgaaatcccagcagggtgccatgcttcacgggcacctggcagtgctgtggggcacattgatgactttggtcccttccgttatggcatgggcagcaacttgtcctcatcaggaataagctctgctctggatgaggtcatgccatgggcctagagaacctctagacctgctcagggaaccccaccctgcccctgcaaccaaggaactcatttccaggcacaagcacagccaggagctaagtcacagccattccccatctcaccctctgtccctggcatctgcagcccaggagccatgcaacctggttggtctgaggcagggcaccccacaagccaggaaaagctccagtcctggcttcaggaggcaggagttggaggaggagtttcagcctctcactgtcacactagtgcccttaagctctgcctcccgtcctgactcagagctgcactggtctgccgtgcagcacccacggggagacatcgttacagcccagggatctggagccatttcatgttccatgggccacaaggtgagtaggagaaagagggtgtgtggttgccattccggcctgcagttgggcaaggagacgggtggagctggggacctcagaacgtacacctacgacatgctgatgcactggcgggagacctctgcaaccccaagagggcaagagccacaggggctcagacaccccaggaataaaactgggaccaggcacagtggctcccgcctgtaatcccagcactttgggaggccaaggtgggcggatcacgaggtcaggagattgagaccatcctggctgacatggtgaaaccccatctctactaaaaaatagaaaaaaattagccgggcctggtggctggcgcctgtagtcccagctactcgggaggctgaggcaggagaatggcgtgaacccgggagacggagcttgcaatgagccaagatcgtgccactgcactccagcctgggcgacagagcgagactccatctcaaaaaaaaattttttttaaaagttcggtcatcccaccagggaaagaagccacctgtgcgaggctcttgctggagacgagggcagcggtggtaaggtcaggagtgaaggcaatgccgataccagtggcagcttggggcccccagaggaaaaggagggcgcctcgactttcttgcctggggctatgtgctttctattttattttctttcctcttcttcccctgctgttgggtgtcaggtaggttagcagtgggtagttccagcgtccactccacagctgcagacgcccggcagaccctcacccgaactcaggaaggtggacatcccagacagcaggcacagctgagccgcccagctcatctcctggggggaaagggagtgtttttattgatcatcagatggctgcacggtgccctggagtcgtgggagtgggtcaggggaaatgtgtggctcccacgggggccgagtgtggcccccgctgccgtgtctgccccaaggccttcctgccaccttctcctggtaacagatgcccctgtttcgtgctggaactgccctcacctgacccacgtggttctagtagagttgttacccgacccccgggcctggacgatcacacggccgtgtcccctggcccaggggagcaagccctttcctggaatgaggaaggaccctgcactcctactcggtagccacactggaagcgagccgacctggccctgtctgagccatgcccccattctcctcccctattccccttgaagaatagggaaacacgtgtttgcagtggagaagcagaggccaacacacacagggagaaagagcaagggacagaaacacagagacaagtggaaagacagacagaaccctgacgacagctgggtcctcggaggctcagaggcccagaggcccagaggcccacgccgcccaggcctttccggccatagcttccttttgtgctgacggcgtttgagctgattccttcagttagaatcctaagggtcttggtgctctcagcccctgccctgcacagagtagcgatggatccactgcccctggtgacagtgtgtgctctgagtgtctctgggttcccggggccccacaaacactgtggtggcaggtgggaacgactgaggcctgacgaagggggacgggagtcctcccccccgagtacccacaagtacccaacacaaagacctcctcaaaagactggactggacactcctccatcagcagggtctacctcactgatccagtatgaatgacggcccagccactcagccagggaggtgagcagggccagtagcagcacaaaacccacattccgtcctgttccatacgtgtgtgagtgaatgcagcccttgtgcatgcatagaaaacgctctgggtcgggtgcagtggttcatacccataatcccaacactttgggaggccaaggtgggaggatcacacccaactctggtgctggggaggatgctatccttgggcccaaatggggctgagggcaggatagagggcagtggcaggtccagcctcttctctcctcggcctgggcttctgcgtgaggcagggggctgccagtgttgagggcacacctggccatccagagcgtggccaccctgtggtgggtccctgctgtgcctgctgtgctccaggaagatgggaaggggtctgtggccacacctgtgtgctgcttaaggtggtgacgtcacagcctttttcatccagggacccggaaagaaggagtgtctcggggaagacagcagtgggggcctcatggtctggagccctctccccaccagatagatggaagttctggaatgttcctagccggttctgcttctcttggcctgcctcttgctgtgggccctcaggcaggccactggccttcctgagacctgatttccttgtccatgaaaatgacatggaaggtgacagcagcaggatggctcatgggagacgtggctgagcactgggcctgctggcgcctcttctccagcatcagctcttcctttccagttaccgggggtgggggggaactatattgcccagtacctgtccccgctttttcctcagtaacagagccccaactcgtaactgggcacctggccattaagagtgaaaattacatttcccagcgtgccttgcaactagatgcagccatgtgtctgagttctgggcaacgagggtgaacagcaatgtcacgtgcagcagaaagtatccttaaacataaggctgtgctcttccttcctgctagttggaatgtaggtgtgatggctggatcctaagcagctattttggatcatgagaaagaagccacagtgaaggatggcagagcaacaagctagaggagccagggttcctgatgatcctagaggcatcagagtggccctggaggccttaagtaaaagaataagaaacatcccccttccttaagtcactacgacttctgtgctgtttctgtgaagcctgaatctaatcctgatgtctatgttggttacccatcagtctaccctcagtctctttggctcttctctgtgaccagccctgctggcccacacccaacatccactctccacttctccctgctctcgttctgctgggaccccccctttgagggtcccactctccacttcttctcccccccgccgttctgctgggacccccctttgagactcccagggccctgtggtctctgaggttgaggtctactctcagcttgatgttgctgccaagccagcccctctcacagcacagagcgctcagcacagcctgtaattatgtatttattgtgggtttatttgattgctgcctccccaggactgtcactaatgtgagggcagggcccctgcctggtattcacatgatatcctcagctcccggctgggggtctgggctcaagcaggtacccagtgaaccctgggcaggtgaacctcgtcctggtgagtgctgactccgtgacccaccaccctccccaccccttcctcggctaccccggccccagccactcctgtccctctctctaccctcccccaatgcccagagtccccctcccagcccttttcttccaccccattgtcttctctgcccccttcctgaccttgcattgaggctgcaggcctcggggccttccagtgacccacacccagccacgtttcattttctgaacttgggtttcaaacatgaggaaggaactgaggctggtgttccaggagcggccccagcgcttgctggtggctgtgtgggggcacaggccccccagtaagtctcccatccacaggggcatcagaaggatggagaggtagagtgtctcccccaccccccgattggcctataggaaaggacagacagtccccagtgctggcaccatgtggggcaatcagaacccacccacactgcgggtgggagcagcggtcaggacagtggcttgcagagctagcagtgtctgctaacatccaccagaaacccccactgtcgggcacaaggagacacacactagaatgtttgtagcaacactattcacagactttggagataatctaaatgtctgtcaacaagagacttggtagataaagtgttacatccatacaatggactacaacacagcaacgcaagagaacaaccacagacacacgcaggacgcagcaatgcagtgagcacgggcagcattgtgtggcgtgaaggcgccagcctcggagaggacggctgtacagctctgctggcgcggactaaggatcaggcagagcagtctccgggatgggtggcagagcgctcctgggcttgcatgggagggggcacgagggagcctctaagggctgggagttctctggaccgggctggcggttgcacggatgtgcacgaatgtgaaagtccagtgatctgcagcttaagattggtgcacctggccaggcgcggtggctcacgcctgtaatcccagcactttgggaggccgaggcaggcagatcacgaggtcaggagatccagaccatcctggctaacacagtgaaaccccatctctactaaaaatacaaaaaaagattagctgggcgcggtggcgggtgcctgtggtcccagctactcgggaggctgaggcgggagaatagggtgaacccgggaggcagagcttgcagtgagccgagattgtgccactgcactctagcctgggcgacagagcaaaactctgtctcaaaaaaaaaaaagattggtgcacctacttcactttttttttatttttttatttttttggaaacagagtctcactctgttgcccaggctggagtgcagtggcacgatctcggctcactgcaagctctgccttccgggttcacgccattctcccgcctcagcctcccgagtagctgggactacaggcacccgccaccacgcccggctaatcttttgtatttttaatagagatggggtttcaccgtgttagacaggatggtctggatctcctgacctcgtgatccacctgcctcagcctcccaaagtgctgggattacaggcgtgagccaccgcgcccggccttttattttattttttgagacggactccctctattccccagggtggaatgcagtggcgcagtcacggcttactgcagcttcttcctccttgggctcaagcagtccgcccaccttggcctcccaaagtgttgggattacaggcatgatccaccacccccagcccggatcccagtttttgatgtcggtggaattggagatggcaggcagggccatctgtgtgccagctgtggttgattagcaggggctgcctggagaatgatctgagggcccgaggccaccgctgggctccgtgggagagagtggctgatggattagtgatgtctgccacatgcgctgcaggaacgagaggcagcctccatgtccctgaaagacggccatcctcgcactaacctcacagccccccacaggcagctcactccagccaagcccaccaccacctcctcaactgcaacaaatgcttataatgacagctcatgtatatttatcgagcctgtaattaccaagacagtgtgctgcacgtcacctacatcccctcaccctgcccaacaaccctatcatcatcgccataccacaggcggagaagccagggacaggggtgcctcgccccagcctcctgatgcctgcggcagaggcccagctgtgcacagccacactcccccggatgccacgtccctgatccccatggtggcacctccttgccccctgcttttcttcagcttctccaccactcctactcctccttgcccttcaaagccacctcaagtgccaccccctctctcctcattatccaagagtcctccccctcctgagcctctcaggggacctgggcccgagccaccttatcaggaacttgtgcatggctgcagtgttgggtcacacatgtctccaagtctgaactacatcctttcttccttgggctcctggggctaagcccaacctggcagacaaaggctcccctgagaaggtttgatgagtgaatacatgtcccctgcctcagagggaagcccccatctcaggcctcacacgggcagattcatcctccttccagatacaggccccatgaaggggcaacagcaaacaggatcagtccctgccctggggaattacagtcccagcagtggcttgtgacagctgccaagatgggcaagcattggagcatccaggaggacccccaggaagagggcctgaacaacaccgtgcacgtgcgctgacacggggcattcctcgtcctcagtcctgcctcgttttgtgactcatcactttcaggatgggaaaccctccaaggaaggtccccttggctctggggtggctcctagtggatctgcaagaggcggggcccagcctggtcgtgccccatcttaggctgcctctgcatgggctacacatccacaaaacaaagcaaaacagcaacattttctacgatgcttttattcacacttcaaaacaggtgctggacatcttcccattgccccatgccagcccctgctctgtgccccgggaagctgactgtaggtacaggatccatggggcctcgttgctccctggcctccacctagttcagccaatgcgtagccggtagacaagccaagcggtcaggaggggtgaggtcagtgtacagcagcagctcctccctgccgggtcgctgtgtccctctccaaggtcagggctcctggagacggcctctcctgtggctccagctgccctccaggtctcagggggtaacagctcccctttgttgctggccctgggtactgcacagctctcctttaattcacgtattttccatttattcaattctcctcaaataccctgtctgagggtgccataaaaatgtaagactgtgtcaattgcccatatcaaaaaacatgcttgtacgttccacttgaagtagtttggaggggagactaatggaaactagggggaggctagcccccaagcctccgctgaggccaccgctgtctgtgtcccgagggccctggagtaggaggtgtcaatgacggactcaatgaatgaatgaattgatcccaccaccaccagcggcaggcccgcctcttccttccacagcccaccttggcctccccgcctcgccaggtggcaaggccttcgctcctggtccctgagcgccgctcgcttccctcccgcgtgggcagggggcagccgcgacgccggcccagcgcctccgagccgggaaccgcacagcacccggcgatggccccgagccccgcgcgcccgaagccacggcgccgctcgctgggggcctcgggacggcagggacggctgggggtggcgcggaccgcgtccccgaggcgcgtagcgcgcgatcgaaccacgcgccccgcccgctgcggtcctctaacagcccctcgcgccgccccacgtggggccgcacgggctggcggccccctcacccgattggccgccgcacagccaatcagagagcggaggcgatagcggccgcgccgattggctgcggcgggccggcccgggggagggggcgggaccccttttgttctctccgcacctccgggttcgcgcgactgtgagcgcccccgccccggagcaggggtccgcgctgggggtccggagggcgggggcgcggcccgacgccccacccccagcttgttcactgccgccagggcccagcgcctgaagcgcgggtccttcgctgggacgagcgctttcatctccgtccctcagtttccctccccttgtcttctccctgtgtcctgggagttatggggaagctcagcccttggcaaatgagcttgggaccttcctaaaacctaagccaatgataggcccgatcttgcctgagaggggcacgtgagagacccccaagctggagaggcagatgtcctggtaactctaacctgagaccgttttcagggtgagccttctcctaatcacggctggggcgtcttcgtccaaggtggggctggatgggggtgggcagaggcccccacagtcacagcctggccagctgtgcaaatgctcccctaaaccgtcccccgcttcagtcactcagccaaccaatcaatcgcaggggcctccctctggggtggaaagtggtggccccagggaccagggaccttcacagggagagagggctgtggtccgggcaggggcgtcaggggttcagcctgggtctcctgacctccaggcccacgtcttcccttagacaacacctgagagcatctcccagcgtggctgtggccacacacatccctgggagtaggacgggccaccgcgctgaagctgtggatgcagggctcccaatctgtaggcgaggggcctctcccctgcaggggacaggatcaggaccctgggagccctcagtccccctcccagcactgattacctggaaaaccccccgagcccaggttgatgaagaaggtgggaccctgacagtgagtggcctgagcctgggatggtagcttgacctcatctccaaggtcatcctcccagacctgggagtctaaaaacattaaatccttcagaaggacatatttgcatcagatcactgttcagaacgccactggtgccattcacggagcagtccctgggctgaagtggctgctctggtctggtgagcgggggcacccacgcgagctcccaggcccagaggcctcccccagatcctggtgttagtggcccatggaaggactcccagccccagaggcttggcaggtgtctgcggctccccaggggtggggtgctgggaggctgacatctgtggagtgtttttactgttgaacaaattgaatcaattaaacaggccccatcggggtggctgggagcggtgaacaggaggaaagaggggagcggagccaagaggacagcctgagggcgtctgtctccccaggcggggttcagacgcacctctttccctgaatgttccagggcaggagaccccccgtgttgacaagagggaggtgagttagtggagggggagtgggaggaaagtcagtggggactgtccctgttgtgtgtcccctgaaagcacgccaaggcctgtgtctcctacccagccacctctgggcttctcagcccccagccctgtgatgaccctttggacatcccagcctcctttcaaagacattttattgctctcacaaggaggcctccggaagctgggaggctccagcagagaaagagaggaggctgcctagggaggctggaggaggcagagaggaaagaggaaacattgtgggggtaatagcaagggccccgggtcacccacctggagcggaagcctccccctcgggcaggctgagaatgacgcaggcgccggctgctctgtgacccagctgaccgagggacagcccctgcctgggagctccagcagctgctgcagcgtccctcctgcccaagcaagggccgcagggccacccctccaatccgtccccagaggtccactgccgctgcctctcctccagctgccgctcaggggagcgaggtttcttgagtcaggccaccggcagcgggcggccagcccctctcagcatggcgcttgcccagggcctgggctccgtcacatgccaggacagtggtcaccgtcaccctggacagaccacctctgtccctttatgtcaagtgaccattattgggccccctgaggcagacgagcgtctcaccagtaagctcccagggaggacggcgtggtcaggacctgcccatccgccagcactctggcctctaggcccgcaggctgagggcaccggcgggcaccagaacaggggctggtttggccgagggacctgcttcttgggcagcaccaggaaacagccggagaccctcccagcgcccacatccatggcgtgagccccgcgtgggtgcagccccttccgcagcccgaattccaggccagccgctgcaggagggaccgccagccaggggcgcagggcagagggtgggggaaggcgtggcgctcgcgctctcggctcttgcttggatggcgccggctgaggacccccacacctgcgctgcggtgcagaggtcttaggatccgagggggctgccggtctgggccggcgcgttcaggccccgggcggtggggcggcctcggcgtgcgtggctcggttgcctgcaggcaggcacgcggcgctgtgagaaacgaacgtccgtgacttagcccacgggaccgtttctgcattttcaccccaacctggagagctgcagcacagccgcgggacaggaagtcgccgccaggtgggtcaggactgcgacctgaactcggctctgcggcctcccgctccggccgccggttcgcaatcctggcgtgaaccagcagatcaacctccggcgcccgccacaggcgccctcccgcgggaaccggcaggcaggagcggtgcgggggcgccctccagcggccgtggccgggatggcggcctcctgccaggctccaagcgtggccgcgtgggcagcgcgcgcagcccgccacggaaagacaggcgctcctcctgggtgggccttgggaccccttcgcgccctgtgtggccgcctcgtggtgagcacccccgcccctccctgcaaggccggtgttcccagctggaagggcaggcaacctgggaaccagagggagctgctctggttgggaggaaaaagccagctcggttcccgcctgagccccgaaggggcggggctgggaagggggcctggccagagggaaggagcactctgggttgggggtgctgggggagcacaaaggcaggaactggggagcataaggccaggagataggggagaacctaggcaggagctgggggagcagccaggcaggaactggggagcatcgatgcaggagctgtgtcgcgtgttatccccgtcacgtggagttgtgtgtcctgcgaggagcacagcatttcagggcctagagcccctctctgtactggagccgcctgtgtgtgtccattccgaatgagccatacttccctcgcagctctcccagtgggattgagaactgttaggcacacacctggtgaagcattgctgccctttctgttggggagaagcggccttctagcgcagagaatagctgcttcctggaactgaaatcctgccgcatccagaccaagagcatgcttggagcaggcatcagtgcacacactgcttccgaaattacagctataaattttaaaaaaatttttttttcaaggcagggtcttgctctgtggcccaggctggagtgcatttgcaccaccatggctcatggcagactcaacctccctggctcaagccacgctcccacctcagcctcccaagtggctgggactacagacacatgccaccacacctggctaaatttttttttttttttttttgagacagagtctcactctgtcactcaggctggagtgcagtggcgcaaactctgctcacggcaagctccgcctcccgagttcacgccattctcctgtctcagcctcccgaatagatgggactacaggtgcccgccaccacgcccagctaattttcgtatttttagtagagatggggtttcaccgtgttggccaggatgatctcgatctcctgacctcatgatccacccgcctcggcctcccaaagtgctgggattacaggcgtgagccaccacgcccggcctagtttgggcaagttacattttttttttcttttttgaggctgagtcttgctctgttgcccaggctagagtgcagtggtgtgatcttggctcactgcaacctccacctctcgagttcaagggattctcctgcctcagcctcccaagtagctgggattacaggcacccactatcacacctggctaattttcttatatttttagtagagacagggtttcaccatgttggccaggctggtttcgaactcctgacctcaagtgatcggcccgcttcggcctcccaaagtgctgggattatgtgggcatgagccaccatgcctggcccataattttttaaactgtgatacattttgccattttaaccatttttaagtgtacacttcaaaggcattgagtacatttaccatgttgtgagactctcaacactatccgtctgcagaacttttttgtcattccagagactatccattaagcaccaacttccttttccctctctccccagcccctggccttgccctctccccccaacccctggcaacctcttacctactttctgtttctgtacttgcctattctagatgttttataagtggaatcagacagacgttgtcctttgtgactggctcatgtcacttagcataatgttttcaggccatctgtgcgtggtgtgcgtcagaatttccttcctttttaacgttaaatcatagtccattgtatggagggaccacatttgtttctctattcatttatggatggaaacgtgggttgtttccaccttttctctgtggtgagtatcgttgtggtcaacatttggaataactcgtgttgagcacactgttcgtgttcctgcccctagttctctgggtgtgtggctgcgcggaactgctgggtaattctacccttcgctctttgagaaccgctaatgtgtttttcacggcgcatgcattgtatgagagctccagtttctccacatcctcaccaacgcttactgtttttattattgttcttgttatacagctttcatttttataaaaagcaatttttttttttgagacggagtctcacactgtcacccaggctggagtgcagtggcacgatctcggctcactgcaatctccgcctcccaggtgaaagcgattctcctgcctcagcctcccaagtaactgggatcacaggcacccgcaaccacgcctggctaattttttgtatttttagtagaggtggggtttcaccgtgttagccagcatggtctcaatcccctgacctcgtgatccgctcacttcagactcctaaagtgctgggattacaggcgtgagccacagcccccggcccaaaagcagtattttcgtacaaacaatatactaacgctaactgaaataattaacaaattacagattaaaaaaaaatttttttttctttttttgagacagggtcactctgtcgcccaggctggagtgcagtggcaccatctcggctcactgcaacctctgtcttgcccaggctcaagtgattctcctgcttcagcctcccgagtagctgagattacaggcgtgcaccagcacgcccacccggctaattttttttttcttttttttttttgtaatttcagtagagacgaggtttcaccgtgttggccaggatggtctcgaactcctgcctggggtgctgggattacagccgtgagccactgtgcccagtcaaaatattttttatttacctccaaccccaccacctagagatgaccactgctcatttttgttgatggtatttggcaacaggcttgtctgctttctaagcactgttgttttgtttagagacagggtctccgctctgtggcccaggctagagcgcagcggtgcaatcacggctcactgtagcctccacctcccaagctcaagcgatcctcccgcctcggcctcccaagtggctgggaccacaggcgcgggccccctccagccaagcattgtttttctgacccgcaggatgggagcagggagagcgtggctggccgggggtccaccgggaggccctgcgaagggcaggccccggccaggcggggcgcggctccacgtctcagccggcgcttctgcgcacgggctcactactgggggcggccgggatcacggactcgctggcctcgtctccggagcggaggcgggcagcttgaaggagcgaccccgtgggccggcgcatccctccccaggccccgagacccggcgggagacggaccctccccatgcctcgccgcggaggcccgcgccgagccaggagccgcgcatccattggccgagagcgcggccgcccgggccaatcacagggcggccccggcgcccccgggcgcgccgtggggacagagtcaggcgcgtgcgcactcggccctccccggcggcctccaggcgggacgcggcgtcggcgcctgaagttggggctccgtcctgcctccctgcgggccgggaaaagggtctcgcacgtgcgccccccgcggtccgcgatccccagccgtcggcctagccccaggcgggtcgatcccgctgtccccagccccggaccagcctcctccagctgccgggtggagaggctggggggcttttcccgaggtcggcggcgaggctgagagccccggccccgccgcgcccgaggagacagcccttcgcgggctctaaaggccccggggcctccgggatgttccggggccgagttgtgcctgttgccgtttccggcgcccggggcctccgggatgttccggggccgagttgtgcctgttgccgtttccggcgccgctgccctcgggcaccgtcccctctggccctgccttggtctgggaggggtcgctaagggggcggagggcgctcctagggggccctgcggatctcctggcctcggcccccccgggtggccagagcggggctctgcacaaaggcctcaggtagccgcggcctcggttccgagaaagcccctcgcactgaccgggcctcagctgacccgggcagcctactgacccgaccctgacgcccgggccctccaggcctgtcagagcctccaggaaaggaaatgggctgcggggcgcagcgaggctggacagcgggcgctggcccaggactccccttgcccagaggagaaaatggaggctgagcctccggagagcccagctcgatgccaggagcactttgcagagggacacggatgggggctggcagcacttcacccctgtgcggtaacggagtaaccggagcgcactgaagtcagcagcacccccacccacccaccaaggccaccgccacctcccaccatcccgaccgtcctttgctccctcaacccttgttgctgtggggcttggggatatgttggattctcactggcccggaactttgctccccgagggccgcctggctgtagagcagaacccccaagtcctggagagaagggcagaggccggccgaccaggagctctgcagaggagcaaactctggcctgcggacccagggctctcaccggcatgtaaacctctgtggttcacgaggcttggcgcaccatgctctctgcaaactgggcctcataccacctgtctgccctgcacctggagaactgacagcctacccgcccagcactggcagcagaagctaaagcattcctggaacccacaggcccccagctagcctgaccccctgccccagccccccacggccctggcctggcctccctgcagctcccggaatgcacccaggctgtgctggccccagggcctctgcgtgcccatccctctgagggctgctcttcttcttgctctaggcgcctccatcttctcccacaaatctttgctcacgtgtcttctcagacagcccccacacccctgtctaaatgttcagtccccctcccccgctcctcggccccctcaagcccaattcttgcttgggttctggtagctggtgcccccttccctgctgctgcggacctgagctctttctgcccctctgtttcctgctgcatcctgcctggctcccaggaggcctctctcagcattttctgacaacaaagccggggctgcagatccctggtgagattccaggctagcatcagcactcctctcccgcacgcaccacagctaaagcacacaagggcaccgctgaacgccaccactcccagctgccagagtgccgcatccgtcggcaaggaaaatggggacccttccatagaaaacaggcaaagactgaacagacattcacaatggccccaaacaaatggaaagaagctcacgccctccaaaaaccaaagaaatgcaaattcacacagccaggaaatgtcatttctcaccttccaaactggcaaacgtggaccagggtggtcctgggtgttggtggggatgctggcaaggtgctctcagggagggagggcacagccctggggggccatctgagcctgtggggcacctgttcatgctaaggaatcaggagccacggccccctggggaccccattagcctcgctgtggccaggccaggagaagcccctcagtgtgaggacacaggagcactcagccccaggcagacccacaacctgttccagggccaggactgttccttcctgcccctagctccttccctgtctctctgtcccagtgcagttaatactggatgtttctgagtcaccagctggagggagtgtggcccttcagcctggtcaggggccccccagttggggtgggtggcttggctcatgacctcggtggaggggcccctgggcaccctgctggtggcaggaggaagccagagtggccccagaaacactccttgaagagccaataaatcacaagccccctctgcctaccccctccacatcgccgcctgacgttttttatattgatgcattaatttatccttaaaaataggcaacactgcttgtttgatttccacagaggccatgtggggcagagagtgacaaattatttcctgaccctcgagtagctgatgtaatgagtcccccacactgaaagcctgtgtgtccccggctcccagacactcctcagtttggcttggggccactccctggtactgggatgtcactagtgctgtccttgacaggtgacccatttgcctgaagcccgggatgcccatctgtctgggacctgtttcaggaccgcatgaccttgccccctgggtctctcttccatgccttagagggggctgggggccaggtgggggtgggggcactggcccttcctggggcctgacgaggctgtgacctcggctcatggggacagtttggatgctgctcattcgtttgcctacatcgccaggacaggcaggatctgggagcatcacaaaaaagggagttattcgcagcaaatatgagtgtgttcaaaaagaaatctgaagtcagtttccacgagaattctgtctactccggacaggcagaggccacctgagctcgggacctcccaagaagggattcagaggagccacattccactttctaggtgtgaccctcagtctgctccaagtggacttgagacatcccaataacaacactgactaggtactaaaacaaacacagacaggagcacgtgtgcaccccgaacacacagcagggcagcagccatccagggtgggcagcctcccagatggccccacaggcctgtacccctgccctcctgttggccacgccccaccaagggagggtctgtgtaatcagtagagcagggcagaggcgccagcaggccagtttagagggacacagcacacagcagcttccgtcctggttctctgtctctctgtgtctctctccctctttctctctctctctctgcctctctccctctctctctgcctctctccctctctccctgcctctctccctctctctctccctctctccctctccccctccctctctccctccctccctctccccctccctctctctccctctctccctctctctccctctctccttccctgcctctctccctccctccctctctccctctttccccctctccctctctccacctccactctctccctctctccctctttctgttcccctctccctctcactccctcttccccccctccccctccctctctcaccccctcctcctctccctctctctctttctgtctcccccctccctctccccctccccccttccctctctccctccctctctcgtctcccttcctctacatggggaggagctcactccctgccaacagccaggggaacaagcttggaagtggattttccagcccagcacgcagcctcgtggaagaccacccaggtgagttgcttccagcgcctcagctgctgtgagagatgatagatgcttgctgtaagcccctgtgttttggagtaatttgttacacagctgtagagggccaacgcactgctaaagcagcagcaggagcaggtgtagccaggcacctaagaggagctgcttataaatgccagggggtggctcagcctgtaatcccagcgctttggggccgaggatggagccgacctggacaacatagtgaaaccccgtctctacagaaaattaaaaaaataaaacattagccaggcatggatccgatgcttccgtaaggactttgaatctccaggcagggacagagaagacatcagagactcaggatcaacagcagctgcactgagagctgaggtcctcgcgctgggttgctccccctcccccactgagccactctgagtgcgggcgacgcttccctgggttccttctcgccttctgagaaggcttctgtcgacctgtggcttcagtgggacctgagctcatccccgagaccgccttttttcacttcgttaccgagggttgagcgtctgttactgagggtggtgcgcgcctgtagtctcagctattccagaggcttgatgcaggaggatcacttggacggtggagttccaggctgcagtgagctatgatcacaccactgcactccagcctgggcaacagagtaagaccctgtctcaaaaaaaaagaaaaaagaaaacaaaagcggggaggggccaggcgcggtggttcacacctgtaatcccaacactttgggaggcctaggggggcgaatcacgaggtcaagagattgagaccatcctggtcaacatggtgaaaccccctctactaaaaatacaaaaaattagccaggcttgaagagaatcacttgaagtcgggaggcggaggttgcagtaagctgagattgccccactgcactccagcctggggacagagagagacagtcaaaaaaaaaaaaaaaaaaaaaaaagtaaaacacaggggagaggagacctcagagttgcgtggctttccttttctgacccaggacagcaggggaagccccgcatttgtggccagagccctgggatagatggagcccaaacaccctcctctgcatgtctccattccctgggggctgcaggcccgagctgtctggtcctcccttcatccattgcacctggtgttccttctgcccagaaaattgttggtcctcccatgtatcagaagccacatgctcaccttccagggcacttctgcccacacaagcatttcctccaacatggaaggagggccatcccctgcagcaggcagtactccaggcttcagggagctgcccttcaccagaggggctgtctgcagacccacgcacacgcctggcatataccacggcacttagtaaatgtttgctgactcagggcatgcaggccaactctctggtctctgttatgaaccagaaagtgggggctgtggtggtaacaggacttatttacacaggttaacaacctgccaatgaggtaggaaccttccaccacactgattaagaaactgaggcacaaggaggttgtataactcgactcagattgcacaactattaagtggcagagccaggacacaatccaggtaggctggctctgcatctacactcaaccactgcacttgctgttttcctggaacaaaaccacctgcttgtcgggtgcctccctccatcagcgcctggaccaggacatcagccatgtgcatggtgggcctggagctgccccacgcccgccagccaaccaggtcagtgcggcctcccctccatcatgattggttcaggcaatccaggcctcagccaatcagaacaaagctctggtccagctcgcctggagcgcctgacttctgcactttcccagcatggcggcctggagatgtctcactcactgttgcccaggctggagtgcagtggggcaatctcagctcactgcaatctctgcgtcccgggttcaagcggttatcctgcttcagcctcccaagtagctgggattacagtaggtggctcacgcctgtaatcccaacgctttgggaggcctaggcgggcggatcacgaggtcaggagttcgagaccagcctggtcaatatggtgaaaccccgtctctactaaaaatacaaaacttagccgggcgtggtggcgtgtgcctgtaatcccagctacttgggaggctgaggcaggagaatcacctgaacccgggaggcagaggttgcagtgagccgagatcgtgccactgcactccagcctgggtgacagagcgagactccgtctcaaaaaatatatatataaataaaggagaagtgagaacctctgtttgccatagagcttcgtgcaaatacacgcattgatccgcagaggcaggcccacggggtatccaggtaagaacgtggtgctagtgaggaaaaaattcagatgcaagcagcagaatacccaactgcaggcggttcaatgtgtggaggcttttcttctttttcatgtaactagaaatctggaggtgggagttatccccatcgcgacccagactctttcagtctttctgctccaacatccttggcaggtgggcttttgtatgttgtttgtagggcagctgctggaattccatataccacacacacctctacagtcaaggcacaaagaaaggatggagagacagggccagtcacatctgtgcccttttagagggaaagacaaacctgccctagaagcccctgcagtggattccccccaggcctcaacggccacccatgatcgggcatgctatgagggattcagagacggcagagagccaggttgtcatgacagcaatggccaagcatgcttcattgccagggtcttggtagccctccaaaaagcaaagttccataggcaggaaagaaggggaacagattttggtgggcggcaggtctgcctgccacaggtgggaagacaagacatggggaggttcacagattacgcaggggagtggggatcagatgaagggctgcctggccgggtacaaaacctgagatcctgctgcacagctggatgagggaagagccctgctgctgctgctgctgctccagccccctcagcaacagcatggatgtcacagatgctagccaccagatgtccactagcctcactgccagaaccggttctatgctgctcctgcttatggtgtgaagacaccacaggcttccaactgaaggttggaggtggatgcacctgactggtggagcctgggccatgtgactgagtcctgacagcaagggatgctgggaaagttagtatctaccgtttttcaatttatacagaaagatgagtcctgctttgcaaactggagattaactttaggtgagaaggagattctttatacatgcagggagcataagctggcacaactttttggaaagtaatgtggcaatacatatgagcagcctaaaaaaggctatagcctgtcacccagtaatttcattttagataatctctcttaaaatcgtagtaggggctgccaggcaaggtggctcactcctgtaatcccagcacattgggagcctgaggcaggccgatcacctgaggttgggagttcgagaccagcctagccaccatggagaaaccctgtctctactaaaaaatacaaaattagccaggcatggtggcacatgctggtaatcccagctactcgggaggctgaggcaggagaatcgcttgaacctgggaggcggaggttgcagtgagccgagatggcaccattgcactgcagcctggggaaaaagagcgaaactccatctcaaaaaaaaaaaaaaaaaaaaaaagatggtggtaggggctaggcgtggtggacgcctgtaatcccagcattttgggaggccgaggccagcggatcacttgaacccaggtgttcaagaccagcctgggcaacagggtgaaaccccgtttctacaaaaagtgtaaaaattagccaggcagtgtggatcatgcctgcagtcccagctacttgggaggctgaggtgggaggatggcttcaaccctggaggccaaagctgcagtgagctatgattgcaccactgcactccagcctgggcaacacactgagacccccatctcttaaaaaaaaaaaaaaaaggtagtggctggagtggtgggaaccctttaacactcatgtcatcatgacagagttgattataacccaatcatgtggcagcaactgacttgtccaatgaggagagtaagtgaatctcagtccagccatcctacaatgaatatttaataacccggggaaaaaacttaagttctaatggcaaatggaaagattaggatatacctgtagttgtcttggcaaagtcttacaaggtattatttattgaaagcaacaagccagttgtgcaaacctgcctcatttgaaattacttggcaggaatgtttggaaaattcctcctatttaaaaaaacttccccttgaaaattaggaaaagccttaaaatgaaaatacctgggagaaacctaaagatggttggctgagagctttgaaaatgtggacattcccagacaagttcataatgatgccataaataagaatgcttgcagcccggctcaatggtttatgcctgtaatcccagcactttggaagactgatgtgggaggactgcttgagaccaagagttcgaggccagcctgggcaatatggtgagaccccatctctacaaaaaaattaaaaattcaccgagcatggtggctcacacctttagccccagctacatggggaggcttgagcccaggaggtcaaggctgcagtaagctatgatcatgccactgcactacagactgggtgacagagtgagaccctatctcaaaaagaaaaaaaaaaatggaggccgggcatagtggctcatgcctgtaatcccagcactttggaaggccaaggtgggcaaatcacttgagatcaagagttggagaccagcctggccaaaatggtgaaaccccatttctgctaaaaatacaataaaaattagccagttgtggtgccacatgcctgtaatcccagatactcaggaggctgaggcaggagaatcgcttgaagctgggaggcagctatgtcagtgagccaagatcgtgacactgcactccagcctgggcaacagagtgagactccatctcaaaaaaaagaaaagaaaaaaaaatgaaccatggacataaatgtaaaatgcaaaattataaaagttctagaacaaaacataggagaaaatctacatgaccttaaattaggtcatgagtttttttgtttgttttttgtttttgttttttttttgagatggagtctcaatctgtgtcccaggctggagtgcaatggcatgatctcagctcactgaaaccaccgcctcctgggttcaagcaattctcctgcctcagcctcccaagtagctagtatcacaggcgctcatcaccatactcggctaatttttgtatttttagtggagacggggtttcaccgtgttggccaggctggtcttgaactcctgacctcaagtgatctacccatctcggcctcccaaagtgctgggattacaggcatgagccactgcacctgaccaggtcgtgagtttttacatacagcaccaaaatcattatctattaaagaaaaaactgaattgatattattaaaatttaaaacttgggctgggcacagtggctcacatctgtattcccagcactttgggaggccgaggcgggtggatcgcttgaggtcaagagtttgagaccagcctggccaatatggtgaaacccaatctctaattttaaaaaacacaaaaagtagccgggcgtgatggtgcacacctgtagtcccagctacttgggaggttgaggcaggagaattgcttgaacccaggaggcggaggttgcagtgagccgagatcatgccacttgcactccagcctggctgacaagtgaaactccatctcaaaaaaaaaaaaaaaaaagagcacggaaattcaaattccaacacactctgcaccacaggtccgccttgaggactgtgcgttaagtgaaataggccagtcacaaaagacaaatcctgtacagttccacatgtaggagggacctagagcagctaaattcatacagacagaaagtgaaatggtggctgccgggggctgggtggaggagaaggagttgtttgatgggtacagctttttggttttgcaagatgaaagttctggagattttggctgaacaacagtgcagatgctcagtgcccaactgtatgctcaaaagtggatggctgggagcgggggctcactcctgcagtcccagcactttgggaggcggaagtgggcagatcagctgaggtcaggagttcgagaccagcctggccaacatagtgaaacactgtctctactaaaagtacaaaattagccgggcgtggtggtgtgtgcctgtaatcccagctacttgggaggctgaggcaggagaatcgcttgaacccgagaggtggaggttgcggttagccgagatcatgccactgcaccccagcctgggcgacagagcgagattccgtcaaaaaaaaaaaaaaaaaaaaagaaccgggtatggtggcatgtgcctgtagttccagctattcaggaggctgaggtgggaggatcacttgagcttgggaggttgaggctgcagtgagctgtgatcttgccactgcactccaggctgggcgacagagcaagatcctgtctcaaaatttgaaacaacttcaaagaaggaaaggaagctatgcctgttgcatacaagcagaatcttcctcgcggctcggcctgctccagcctcccggaggatgagcctctgaccagggccggcccaggtgccacagtcacagccagtggcccgcagttctgaggcccctggcaccgctgaggcgtccctggagcttcctcaccagcctcacgcatcctgccggggtggcggggtcagggcccacctctgggcacgggaggcgtgggcctcacgggccacggatgggagcccagggcagggggctggagccctcgggggtcagagcccgtgcgccttccagggcggaggcggtcagccgatggaccaggcggtgccgcagcgacagagggggttgagatcggggctttcccctgcgaccagctcgcagcctgacgtcggcctcgctctggggaaaccaaggcacgggcacgcgcgggcgtggcgccaacgtcctcgctgccggccccgcctcgcccgggacagcgccccggccctgctccccgctctacggccccgcgccccggccatctgcggctcctcttgcttcgcgcccgcgccgcgctctgcccacgcccagccccgcagcttctctgtgacccccgcctgccgcaccccggctaggggcttattagcgccacggagctgagctggacgtgtccaggatctggggagggagcagcccagagagggcagggcctggccaggcctccccaggcagccctgcggtcctgcagccacgaggggaggggacgccacaaatccgggtgccgacccgggccaggagagtcgggaaatgggccttggctgggacccaggccgactctgatcccgcgggcctcgtagcccctccagccctcggccatgcaaagtgggggtcccacgggatgagccccagtgtgggagcccagctcggacagacatcacccctcagtcccccgaccctccgccccaggagagaagctggacgcttgcctgggcgaccaggtccaggccaccctaggcagtgaggagcagcagggggccatggcgagaggacagggagggcctctgttgggcctcggaggtggagaccccactgctgagccacagctggggcatgcattggctttcttctgagcatctgtctggggaaccgccgtgggaggagcagagcccctcgggcactggtagggaagccaggctgccaacagccctgccaccctggctgcaggttctggagccggggaccctctaggctgaagttctccaagtgggttgagcccaggtatccgtttatcctaggtaggcctccatgcctgaaggtcccgggctcctctggaccacccgtcctgccagggggcagacaggcctcctgtcccttcctgttctgttctgctccctaaactccaagctaagtgtgtccctgggcagctgggtcttaagagcctgaaaggctgcatggagtctgtttgttcgttcagaggaatctcagctatttcctgggaggctccatctgagcctggtaggtcccggatgaggggtgggtggcccggtgagcaggtcagcctgtcctcaggggcttgcagcacacccgccagggtggcaattatccaaaatatagaaaacaagtgccactgaggatgtgaagcaactggaactcttgtccactgccgatgggaatgcaagatgaggcagctgctgtggagaactgttggttcctcagaaaggtgcacagaatgaccctatgaccagcagtccacgccggccacagaccccagagaactgcaggcaggccctggaacacatacttcacaagcagaatgtagtatagacatatactgcagtatttctcagctttaaaaaggaagggccaggcacggtggctcacgcctgtaatcccaacccagagggtgaggcaggtggatcacttgaggtcaggagttggagaccagcctggccaacatggtgaaaccccggctcttctaaaaatacaaaaattatccagatgtggtggtgggcacctgtagtcccagctactcaggaggctgaggcaggagaatcacttgaatccgggaggcggaggtagcagtgagccgagatcgtgccactgcactccagccttggcaacagagtgacactccatctcaaaaaaaaaaaaaaaaaaaaaaaaaagagagacagaggttgcagtgagcctgagatcacgccactgcactccagcctggatgatggagaatctgtctcaaaaaaaaaaaaaaggaaggaaggtgtggtggctcacatctgtaatcccaacaccaacactttggaaggcagaggcagaaggactggttgagcccaagagttggagaccagcctgggcaacatggcaagaccccatctctataaaataaataaataaataaaattggccgggcgcagtggctcatgcctgtagtctcagcactttgggagtccaaggcaggcagattgcttgagttcaggagctcgagaccagcctgagtgatacggtgaaacctcgtctttcctaaaaataccaaaaaattagccgggcttggtggcatgcacctgtattcccagctactcaggaggccgaggtgggaagatcacctgagcccagccagtgactgagcttgcaccactgcacttcagcatgggcaacaaagtgagaccctgtctctaaaaaataaataaataaaagtaaataaattaaattagccaggcgtggtggcacacgcctgtggtcccagctactccagaggctgagatgggcagattgctggagtcagggaggttgaggctgtggtcaactgtgattatgccagttcactatggcttatgttacactgcaagaccctgtccaaaaaaagaaaaaaaaaaaaaaggaagaaaattgttgtttaatagatatagagtttcagtcggcatggtggctcacgcctgtaattccagtactttgggaggccgaggtgggaggattgcctgaggtcaggagtttgagaccagcctggccaacatggtgaaaccctgtctctactaaaaatacaaaaagtagccagatgtgttggtgcatgcctgtagtcccagctacttgggaggctgaggcaggagaatcccttgaacccgggaggcggaggttgcagtgagccgagatcgtgccactgcactgcagcctagtgacagagcaagactccgtctcaaaaaaataaaagaaaatagttgtagagtttcagtttgggaagatgaaagaattctgaacatgtggtaatagaggcacagctttgtgacgtaatgactgtacacttcaacaccattaaaatgatcaattttgtgttatgcatgttttaccataatctaaaacaaattttttggggggctgggcgtggtggctcacacctgtaatcctagcactttgggaggccaaggagggtggatcaactgaggtcacgagttcaagaccagcctggccaacatggtgaaaccccatctctactaaaaatataaaaattatctgggtgtggtggtggatgcctgtaatcccagccacttgggaggctgaggcaggagaatcgcttgaacccaggaggcagaggttgcagtgagctgagactgcactattgcattccagcctgggcaacagagcaaaaactctgtctcaaaaaaaaaaaaaaaaaaaaaagaaagaaatttttttttaatcctgcatatcggggagggagatggacgagtaacagagggtggaagtggaggaaggcgtgcttcccgggagaggactgggctgtgtggggatgctgtggacggctgcacaggtggtgcactgcacaactgcaggggatgccattcacatagaccatgatgctgcatcatgtgtgaagtatgcaccacggcagtcctctctggagggcaccctgagaagggccgccagcagggagctggacagcacggggacacatcctttccagcaggaaaggattccaaacgaccaccagcaggcgggcaggccaagcatagctgaagggagccatgggaggccacgaggtgctctgtgtacagcaggcagccccagcacttggcccacgtgctgcacagaggaaaacacctgcccacagctgtctctggctctgatgtttaggacccacctccaaccaagcaagggtcctgtaagtcagaaaatctctcagtcatcggagccaggatttgccaacgtgaaccactgaacttcccccttggtctccatcctctatgaaaacatgaaaggggtttgaaattgcatccaataaacacaatgtccatctcctgccggggaaaattggtctgggtagagggatgccggtggtgtggacaggctctgaaagctgcaggaaggctcggcttggagaacatcctccacctctgcctaccatcaggacccagggatcctggggaaggggagccctttcaggagtgccctgaagtcccccagcacgtgtgacacttctcagagcaggcatcccttccagaagtttctgttaactaagctgaatggcatttaagatattgaaaacaggctgggcgcggtggcttacacctgtaatcccagcactttgggaggccgaggcgggcggatcacgaggtcaggagatcgagaccatcctggctaacactgtgaaaccccgtctctagtaaaaatacaaaaaattagccaggcgtggtggcgggcgcctgtggtcccagctactcgggaggctgaggcaggagaatggtgtgaacccaggaggcggaacttgtagtgagccgagatcgcgcccctgcaccccagcctgggcgacagagcgagactccatctcaaaaagaaaaaaaaggaaggatagaattagaaaaccattaaccaggcgtgctggtcctagctactagggagactgaggtgggaggattgcttgagcccctgaggtcaaggctacagtgagcctctattgccactgcactccagccagggtgacagagcaagaccctggaaagaagaaaagaaagaaagaaaggaaagaggaaaggaagaaggaaagcaagcaagaaagaaagcaagcaagaaagaaagaggagaaagaaaagaaagagagaaaaaaggaaagaaagaaaaaagaaaaagaaagaagggagggagggagggaaagaaagaagggaaggaaggaaggaagggagaagaaagggagggagaaagggaaagaaaagaagaaaagaaaagaaaaggccaggtgcagtgcctcatgcctgtaatcccagcactttggaaggccaaggtgggcagatcacctgaggtcagaagttcaagaccagcctggccaaccaacatggtgaaaccctggctctacagaaaatacaaaaattagtggggcatggtggtgggcacctataatcccagctacttgggaagctgaggcaggagaatcgcttgaacccagaaggtggaggttacagtgagccgagatcacaccaccggactccagtctgggcaacaagagcaaaactccattaaaaaaaagaaagaaataggccaggcgcagtggctcacgcctgtaatcccagcactctgggaggccgagacaggcagatcacgaggtcaggagatcaagaccatcctggctaacacggtgaaatcccatctctactaaaaatacaaaaaaaaaattagccaggcgtggtggtgggcgcctatagtcccagctactcaggaggctgaggcaggagaattgctggaaactggaggcggaggccgcactccagcggcgagagagtgagactccatcaaaaaagaaagggagggagggaaggagggaaggagagaaggagggagggagggagaggaggagaggagaaaagagggaggggaggggagtggagggggagaataatttgtaaccactaatgaaatagcaggtcctggcagggatttccaatggctgctaatatcacaacatcaggctctgtgggactctttccctctccatgaagttgcacccaccctgtggtcatcttcttgctaaaaaaatcaacctgaatgagattaaacagaccagtttggacatttacacctagagctaactgactataggaaatataagggttgaggaacgtgccacatcaaccacaaggacgaaatcagcaaaatccagacaggtggaaccctttggaacaaaagacctgccttcttccacaaataacctgaaaggagaaaaatgaaagagggtaaatcccgcggttaaaagagatttaagagacatagtggccaagtgcaatgattggaaaccaaccgttaaaagaaatttaggtgggtcgcggtggctcacgcctgtaatcccagcactttggggggccgaggcgggtggatcacgaggtcaggagatcgagaccatcctggccaacacggtgaaaccccgtctctactaaaaatacaaaaaaaatacaaaaaaatacaaaaaaaataccccgtctctactaaaaatacaccagccgggcgtggtggtgggcgcctgtagtcccagctactcgggaggctgaggcaggagaatggcatgaacccaggaggcggagcttgcagcgagccgagatcacaccactgcactccagcccgggtgacagagtgagactccgtctcaaaaaaaaaaaagaaagaaatttaaggctgggcatggtggctcacacctgtaatcgccacattttaggaggctgaggtgagaggatctcttgagaccaggagcttgagaccagcctaagcaacatagggagaccccatctctacagaaagtttaaaaattatctgggcatggtggtgcacgcctgtagtcccagctactcaagcggctgaggtgggaggattgcttgagcctaggaagtcgaggctgcagtgagctgtgattgtgccactgcactctagcctgggcaacaaagcaagaccctgtccccccaaaaaaacagacaaacaaaacaacaacaaaaaatttaagacaaccaaggaaatttggacattagatgatactaagtatcgatcaataattggtgggtgggggcatgatactgtgatttttttttttttttttttttttttgagatagagtcttgctctgtcacccaggctggagtgcagtggctcaatctcggctcactgcaacctctgccatgtgggttcaagcaattctcctgcctcagcctctggaatagctgggattacaggcgcacgccaccatgcctggctaatttttgtatttttagtagagatgggtttcaccatgttggccaggctggtcttgaactcctgacctcgtgatccgcccgtctcggcttcccaaagtggtgggattacaggaatgagccaccgcgcccagcttgtggttgttttttcaaaaagagtcctaggctgggtgcagtggctcatgcctgtaatcccagcactttgggaggcctaagcaggaggaccattgagtccaggagttcagcctgggcaacatagtgagatgctgtctccaaaaaaaacacaaaagcaaacaaacaaaaggccatggaggaggccaatccccagctgtgctgagccaggatcagattctctcagcccctttcagcagcacctgtcctcctctgagtcaatatattgctgttgcagccgggcgcggtggctcatgcctgtaatcccagcactttgggaggccgaggtggacggatcacctgaggtcaggagtttgagaccagactgaccaacatggagaaaccccatctctaccgaaaatacaaaattagctgggcgcggtggcgcatgcctgtaatcccagctacttgggaggctgaggcaggagaatcgcttgaacccaggaggtggaggttgtggtgagctgagattgcgccattgcactccaattgggcaacaagagcgacactccatctcaaaaaagaaaaaaaaaagaaagaaaaagaaaaagaaatatggaacataaaagttaccattttaatcgtttaaaagtgtacaggccaggcgcagtggctcacacctgtgatcccagcactttgggaggccgaggcaggcagatcacctgaggtcaggggatcaagaccattccggccaacatggtgaaaccccgtctctactaaaaatacaaaaattaaccaggtacacaggcacacgcctgtagtcccagctactcgggaggctgaggcaggagaatcgcttgaacccaggggccagaggttgcagtgagccgagatcacaccactgcactccagcctggcaacagagcaagactctgtctcaaaaaaaagtgtacaattggctgggtgcggtggctcacgcctgtaatcccagcactttaggaggccaaggagggtggatcacctgaggtcaggagttcaagaccagcctggccaacgtatcgaaattctgtttgtattaaaaatacaaaaatcagctgggtgtggtggcacacacctataatcccagctacttgagaagctgaggcaagagaatcgcttgaacccaggaggcagatgctgcagtgagctgagattgcaccactgcactccagcctggatgacagagccaggatggtcttgttctcctgacctcgtgatctgccagcctcagcctcccaaagtgctgggattacaggtgtgagccactgctcccagcagtttttttttttgtttttttttttttgagacagggtcttgctctgtcatccaggctggagtgcagtggctcaatcacagctgactgcaacctcaatctccccaggttcaagtgatcctcccacctcacccttctgagtagctgggttactacaagcgtgtgccaccaggacaggctaattttttgtatcttttgtagtgggattttgccatgttgcccaggctggttttggactcctgggctcaagcgatctgcctgcctaagcctcccaaagtgttgggattacaggtgtgagccatcatgccctcactgtcactattttcctttttttttttttttattttttgtggccatcctactggatgtgaagtgatatctcactgttattttgatttgcacttccctaatgatcccctgatgatgttgagtatctttttcatctcccggttggccatgtgtatatctgcttgggagaaaataaagtcctttgctcatttttaaattgggttctttttgttgttgatttgtaggcgttctttacatattgtggatactagatccttatcagacataattttgtggggtttggggtttttttgtttgtttttgagatagggtctcactgtgtcacccagactagagtgcagtggctcaatcacagctcactgcagtctcaaacctcaaactcctatcaagagatcctttctcctcagcctcctgagtagctgggaccacaggcaggccaccaccatgctcagctaataaaaaaaaaattggggccaggcatgctggctcacacatgtaatcccagcaccttgggaggctgaggcgggcagatcacgaggtcaggagattgagaccatcctggctaacacggtgaaaccccgtctctactaaaaaatatgaaaagattagctaggtgtggtggtgggcacttgtagtaccagctgctggggaggctgaggcaggagaatggcatgaacccgggaggtggagcttgcagtgagctgagatcacaccactgcactccagcctaggtgacagagcaagaccccatgtcaaaaaaaaaaaaaaaaaaattggctgggtgcggtggctcacgtctgtaatcccagcactttgggaggccaaggcaagcaaatcacctgcggttgggagttcaagatcagcccgagcaacatggagaaaccccgcctctactaaaaatacaaaattagctaggtgtggtggcgcatgcctgtaatcccagctactcgggaggctgaggcaagacaatcgcttgaacccaggaggcggaggttgtggtgtgagccaagatcacaccattggactccagcttgggcaacagagggaaactgcgtttcaaaaaaaaaaatttgtagagacaaggtcttgccaagttgcccagggaacctgcactgggcagttccggaagagctgcagctttcaacgcttcgagagtgcgtgactgtccctggtccccatgccctggccagtgctcagaactacccatctcctgatttctgctcatctgatagccacaaactggcatctaatttgttttaatgtgcatttgctgatgcccagtgtccatgagcatctcacagtttgtcctgtaagtgcaatgcttcacaggacaaagagaatttctatcttttgcaggtatcagagtcgctgagaagagtcatgctgtgatgtgaggtcacagaacaaggtagggtgggagcctggagctcagtaagctctctgcaatttatgtttgcctccaccccgacccccaccaagcttgagcctcctctcccccatccccatatgggagggggagctaggaagcaccaccacctctgcttgagtaaaatctcttccaacagcagaacgatcccttgacccgacttaacatgaaatagttccaaatctcttttcaactggtagagatcttccttccctgtcccaacctccaaatgacttctgcagctgtaagcagttcagaggagctatgcattggactcccaatcccatctacagaggctctcccctggcacctgcggggagaaaagctgaagtacaaagggcactggctgagcctcttacaccaggtgaggccctcgttattggtagatactgagttccaggattcagtaactagccaactccatgactgctgcgctctttacacaaagtaaaactatctcatatcacacgtccacctgagggctggggggaaactaaggcaggcccctgctgattcaggtggttattttatgccaaatatttacccaagatgtcaagtcatctagtttttcctaaataatggaaaaagccgtctcaggacttccctcccagcctgcttatgatgttgcttcagttatctccaacacccaaacccactaggctgccttgttcttgcactttcgatttggaagaaatcgaactgctcagtttattgttaagccgttttctcaccagcccacgaagccaagctgagcagcacccaccgcccccacccccaagactacccaatacttccaggttggtctgtctttcccagcccacttgctacttccccaaacaggagccattcattggttacggcagcacttttatttttccttacacaatgacgtgttgctggggcctaatgttctcacataacagtagaaaaccaaaatttgttgtcatctcttcaaagaatcgagaattgcgtacaaaaaaaaccttacataaattaagaatgaatacatttacaggcgtaaatgcaaaccgcttccaactcaaagcaagtaacagcccacggtgttctggccaaagacatcagctaagaaaggaaactgggtcctacggcttggactttccaaccctgacagacccgcaagacaaaacaactggttcttgccagcctctagagaaatcccagaacactcagccctgacacgttaataccctgcacagatcagaggctgctggccacacagactcaccaagccacagacttgtcttccacaagcacgttcttaccttagccacgaagtgaccaagccacacgtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgccaggggcaaatttctattctcaattaacccatgcagcaaatgctacgcatctgctgagtccgtttagaagcatttgcggtggacgatggaggggcccgactcgtcgtactcctgcttgctaatccacatctgctggaaggtggacagtgaggccaggatggagccaccgatccacaccgagtacttgcgctctgggggtgcgatgatctgcaaagacagccaggcacggcttcagctcacagagcgccccccagtcagctctcccgagccaggcagagggccaccaacccctcgactcaccttgatcttcatggtgctgggcgccagggcggtgatctccttctgcatcctgtcggcaatgcccgggtacatggtggtgccgcccgacagcaccgtgttggcgtacaggtctttgcggatgtccacgtcacacttcatgatggagttgaaggtggtctcgtggatgccgcaagattccatacctaggggacagagccctcccttagtgatgctgtgtcaccgaggatgtaagagtagaaacctttagctcacaacacctacccaggaaggaaggctggaacagcgcctccggacaccggaaccgctcattgccaatggtgatgacctggccatcgggcagctcgtagctcttctccagagaagaggaggatgcggcggtggccatctcctgctcgaagtccagggcgacgtagcacagcttctccttgatgtcgcgcacgatttcccgctcggccgtggtggtgaagctgtagcctcgctcagtgaggatcttcatgaggtagtcggtcaggtcccggccagccaggtccagacgcaggatggcgtgggggagggcgtagccctcgtagatgggcaccgtgtgggtgaccccgtctccagagtccatgacaatgccagtggtgcgcccagaggcgtagagggacagcacggcctggatggccacgtacatggccggggtgttgaaggtctcaaacataatctgagaagggacaaggggcggcttagtcagggacagagacccacggccaccccatgctcacacgccacaacatgctgcatgccagtgtgatgtgtggagaaaagaaaagaacgcaggcagaaaccaaatgagaaacctggaggcttcagggaggaaatgccgggagaggaacagagcctggaacagcgaaagaaacacttaaatgtcagaaatcaagccgggcagaaaatgactggggaaaggacgggaggagcacgggcgtcggccgagcctcacctgagtcatcttctctctgttggccttggggttcaggggggcctcggtcagcagcactgggtgctcctccggggccacgcgcagctcgttgtagaaggtgtggtgccagatcttctccatgtcgtcccagttggtgacgatgccatgctcaatggggtacttcagggtcaggatgccacgcttgctctgggcctcgtcgcccacgtaggagtccttctggcccatgcccaccatgacgccctgcaggggacgacccgtcagcctcgccggcgacaccgaacccaccccgcaacgcagaacccaggagccccgcggcgccatccactcacctggtgtctggggcgcccgacgatggaaggaaacacggctcggggagcgtcgtccccagcaaaaccagctttgcacatgccggagccattgtcaatgaccagcgcggcgatctcttcttccattgcgacctgcccggaaaaggatggactcaggcgggcgcgtctgtaacacggtcccctccccacagccacctaatgccctcccgcggggaagcctcggccctgccccaaccccagcggccgtggcctccaagatcgcaaccgcctggaaccgaaggccgggccttttacgtaacgtccacggctcggaagtctgcactgcggccgggccccgccctggacccccggcgcccccccagccccgtccgcctgacccggcccaccccgccttttgttcccggggaaggcgcgacgaggcctcggcagctggaagcggggccagccggggtcggggggcgcaggcctgcgacgtccagctcaggccccggggcggggcgctcaccggcagagaaacgcgacggcggagcggcggaagaacagagtgcgagagctggcagcggcgactgagaccgaccgcggcctcccccgccgttatttaagcggaagcggcgcgcccgcgcggcccggcggcgcgcgcggccccagaacatgtccatatatggcgatctttccgaaagccgggcacccattggcccgccgggcagggacacgtggggccccggcccgccccgcccccagcccgcaccgcctcccaacggccccgcccgcgccacccccgcgcgctcgcgaccctgcgcgggccggcgggcgggtctgagttggggcgccctccgagggtcgccgggagggccgaagggctgacgggcctggcccctccccgggactgccgcgccgtggggagggccctgctgcgccccgaaactgcctgacccggggcggggccgcgccggagctggggtgggtccccgagtccccggccacgctgcggggctttgctccctgggacgtcccttgcaatctttcccctcgggctccacgaggatctcgggcgccagtgccgggctgaggaaggggcgcggcgggggtccgcgacgctctgcgtccctgggcgcgggggagctctcaggagccctcacctcgccccggtcaccataggaaacagcccgcccgtccccaagcgcagccaccaccatgcaggtccctccacggggcgccctgccccggatctccgttcgtttgaagaccgaggcccctttctacccgacccgacacatccctgcccctcaaatcacaggcctgattgtccccaggcgcgcgctccgggttggggctaccccgcccccttatgtgctgagaaggtggtgtggagtgaggcctttgtttcattctggtcacctgtagacattatagggaaactgaggtagacaatgggagccctgacttttttgaaggtcggctccccagcttcgggcggtcggggggataccctcttctgtttacgatgctagttaagagcagcgatcagggctggcgtgggtttagccacaggcttgtccagggcgctcactcctcgccaggagcggcgccggtgctttggttacaccccgagaggcgcccggcactacggtttccttgtgcgctgctggaattttcagggttggagcgccggccgcgtaggggtggcagtgaggccgcgcagtgaggggacggactcgcccgaggtcgcagagcgttcagattgactcgacaggctggggggcggggccggggtccccacgcggagtccggggccctgcaacgttagctcgcgaccccgtgtttgggagtgacaacagcgagtcagggcaaggcggccggcccagctcacctgcgggctgcagtcagcccggacgccgagacccgtgcctaaggcccccgtgccccaggcctcccaggggtgctgagcgcccccaggcccagaatctccgggggcccgggcaaggctgtcaggtatgttccctcccgtggcgaagccggggctgggcctccaacagacccacccggactcgcgtccctgggcagaaccacacagcctgctcgacccccgggtgaggacttccacttggggggtcccaagatgcgacgtcacacaccgagggacacgaggcgggtggggaatagccacaagcccctccatcctgcgttcaccccacactacgttctgctccgggccggccggggaccctgcccctccgggtctctggtctcctccgaagcttctttgtctaggaagtgcggggaggtgccggccccgggcgcgcgtccccgtcccccacctttcttccccacgttgcggacccgaggccgccagggtcgtgggggcgggggcgaggctggcgcctcgagacccccgggttccccgccacccgcagggcctgagccgcggggaggggcggggaggggacgccgccgcgggccgggggtggagagcgacttcctcctccgcggccgcgtcacgcggcaggggtcaaggtgtggcccaggtacgcggcggggggcggtggcgcggccatatttggcgacttcggcgccgccggagccccgcccgcctccgccgggaagcccggcccggggcagcgccatccccgcccgccgccgggcctgagtcacggcgggcggggggcggaagtaacggacggggggcgcccgcccggcgctcctggccttatttagtcaaggaggccgccgattggcgcgcgggacagaggggcggcggccgggcagcctcggggcgtaggagtggcccggcgcctccgaggggtcggggcgggagccgggcgtggggggcctcggagcctggggagtcccgggaccgacggcggcggggatgcgggtctgcctgtccctgggatgcgggcgggcgggcagggcgaggcctggagcccgcggggcgcagggggctggaccgcgcgctgtgatttttctgtttagcagcggggcctcgcccaaggtcgcgcggggcctgtcctggatatgctctgggaagccagtggcgcagggcagccgccacccttctggaaccagtgccggagagggccgggcagctgggcctggggaggggaccgcatggatggagctgggggtagctgggcggcctccggagccgggagagtcggcagctgcacttccgccagaggtgggtgtgtccttcacatttcaggaagggagacttggggcctggagaagcgatgtgatttttcttttctagttcagtgctggttttgatggctttttatcatgaccttgttatgtcttattttagtttcggcccatttagtggatacgacaacagtggcccagggaggtatggcagagctgaggcttaacccagggcctgcgccctccacggcctgcactgccccacctccagctccttgccctgttcctccctctgcaccggatcagcccccggactctgggtcacctccacaccagttgacagggccccccagtccccaccgccaaccacctggccggctacttgtcagacagacatgggggcgtgggcatgggtccccacccctagcctttgcctctgtcactctacctgcctggaatgtctactttttctttatattttattttattgtatttttgagacagtctcattgtcgcccaggctggagcgcagtggcgcgatcttggctcgctgcaacctctgtctccggggttcaagcgattctcgggccttagcctcccgagtagctgagactacaggcgtgcaccaccatgcctggctaatttttgcatttttggtggagacagggtttcaccatgttggccaggctggcctgaactcctgaccttaagtgatccactcgcctaggccttccaaagtgctgggattacaggcgtgagccacctcacccagcctggagtgtctcatcttccaccactaaatgaaacgatggaccctgaacagaaaaaggaacagtggtggaagaactagcaaagcccacagccttgagtttggccgtaagtatcaaggttaatctctcagttatggcagttgtcccatgaccgtgtaagatgccaggttaggggacactgggaatagagcattgggaaaccttcccactgtctttgcaacttttctgtaagtttaaagttctcccataataaaaagctaacttgaatccaaggcaagcaaagcttccctactctcagcccacctccctcttctcccacacccttttggacagatgaaatgcaaggtgatggccctgtttcctgaagctctttccagggcctggctggctcccttgggcaggtctggagtgggctctgcctcttcaggaacagtggtcccaaggctggtcccggtgggcaaggctggtttcctgcaactcggcctggctgcctctgagttttggctcaagggacaaggccagggtcccacacttctgtctcctggctggtgcccagcttggggcttggttctcctgccccactgcgcagactgaagctcagaaggctcagctggctgccccccaccccacccctgcggagtcactgggcagctggctgtgagtggccaggtgctgcttgtttggtcccaggaccaggtctctgcatgtgttgtccaattctcacctggtccccagaccaggtctctgcatgttttgtccaattctcacctggtccccagaccaggtctctgcatgttttgtccaattctcaccactggaggagagtcccagactgtggagttttcacagggagggaaactgaggcagtctcctgggtcagggtaattagccagaaacaaggtcacattctgggaggtcagaaggttctggagggcggtgtgggcactctacacgagggttaggggcttgaatgcacacagacactcaggccgagagtccctcaaccccactcccctgccccgccccacccccgctgctccaggccttctggagacaggatccctgttgcagtttacctgaggctccccatccccgctgtgagcaggaaccaaggaggcccctggaagagccctgagctgggagtcggacacctgggttctgggcccggctcagccctgtgcctgccacgtgacctctctgtaccccagttcctgtcaaaaaagaggagagggctctgcgatgtgagatgtgtggcccatcaggggctctgaggctgcttgccctcccgtgtggacaggaagtctggggacaggaggccgtcaggtggcccagcaaaccccccaggcgtcttgcctgacacccaggggctcagttttcggtgatgagtaagacgtgctcagtgcctctgtgtgtcgtgtgtgagacctgagaccagggtgcctgctcctccctctgttcccaagggcatagccccaggcccgtttgtgaccctccactgggcccgagaagaaggctcctttccccaggcctcattcccctgtggcctcccagagccgcacggagtggggagggtctgctctccacctggccattgtggaccccaccccaggagctccggccgccccccccccctccagtcccactccttcctccccagaggcagcgaggcctgaagtttgtgtttcccctcagggtggttcttagctgcggtcacagattgcaggggaggagccagaaacggagatgaaaccgaggagcccccaccctcttcacagggctaaagccagaaaccaccgtcccaggccacagcctgcctcatgtggccatgcctgctccctggcagtgcgcgtcctgcaacccttcccaccccagggcctcggcttccgcaatgaatccccatgtttcaaatccccgctgctcccaaggctacctgctgcctcggggtagaatctaagccccttcccctggtgctggaggcccacagagtgggcgctgcctgtccctccactccttcagcgccctgaccaccgtctggctgttcctttgcccccaaagctgtcccactggctgcctcctcctggcatgcccccatgccacccacgacctcccatcaactcctattgattattagcttctttcacccactctctgccctagagcattggttcttggggcacagcatccttgtcctccacagtgaagctggtgcccctgtacctggcatagcccctgtacctggcatagcccctgtacctggcatagcacctgcccagcagctgctcgtgcaggaagcccaagtaggggtggaatagagagggaggagttcccagccctggaggagggagcgcagaggaaggctaggccgattcgcagctgcctcctatctcaaaaacgtggaaggggctataactctagggctgggagggaggggagtcgttttcgctgactctccgcacggaccctctcctgcccgctagctggtcagctcctccagctctccccgcggcagcaggccggggagcagatgtcttgtccagtgtgcgcggggcaccgaggtagggaaagcctgtttaacccgtcccgcccctcctgctctggccagcagctcgcccaagcagctctgcagagcgactaggtcagggcctctccaggtgtctccactcgagggacggctggcgccacgcggaaaaggggaagcgggtcagggcgggacaagggcaagaggttactgctctgggcgctgtgtcctaagggctgcctcttgtctgcggagaatggagggtgccgggggtcaagcccggactctgtcagggtacccgagtcttagccacgccatccttccccagcgcgccgcgggggcgggcacagcagggcgggcgtggctgggagaccggctgtgcctcgccgccccgcccgtcccaggccgggaagctgggacttgagctggtctgcattcgggcaaggtgagccccgggatgtttctcaggcagggcccagggctgcacgccctaacttggtgcggggtcgcggcggtccagcccggctgcacgtggtcgcgcgctccttgcagctcccagcccgccggcccgcgctcctgcgccccctccccacgcagtcgacctctcctgaccgccaggtgcacgcagggcgcgggcctgggcctcagctccgcgcactccccccgggacgcggcaccggggcttcgggtgggcccaggacccgcactcagcacgcacttcccccgccgagcactgtctggcagcggggacgcacccccaggaccacgagctcggaggcctggggccgggagatggcgcccgtggagtgggtcccgcgagaaggccgggaatggcgggccgctgtcgttcccacctgggccgccaggtgggtgccgctatcgccgcgaggccgcacctgtcgcgctgccggagcccgcgcctgcccaggagcgccaggagggacccccgctcctccctccgccactgggcggggccggtcgctgagtcacggccgcacaccggacggtgacagaggcagggctgcctggggaggggccggtgacctcagtcagggctgacgcggaaaagtgggatggggtcacccgtggcagtggatgagggggtggcccgggcctccactcactgcccacgctagatgtccggggtccctcctgcgaccgaggacaggaggcacccacagaggaccccaacacgaggaccctggccctgggtgcggggcgtttttcccgcactctgctcccctagcagatggcccctgctaagcaccagctcccagaaaaggaaaggaaggggctgagaggctggatcgaggcaacccagcaggaaaaggtggctccagggctggaggggtgggactcagagatctcactacatacacctgctggggacagaggcttctccggccttcccagggctgggccaggccgtggcaggggccgccccagacctgtgtcccaaggggccaggttgtttgcggctgggctggctccgggaaagtcagagggggcactgccggacaggggatgtccagtgccacaccagggcggtcacacttcctcctggggccgtggggacacaggaaggcctaggggaggggtggggggagaacacactcaggaggtgaccctgaaggtggagaggcccgagctggggtcacaccatgcccagggaaggatcatggttggcccaacccatgtgtccacttggtctgtgggagggaatcaccctggggagccccctatgcctggcccccacccacacacaccttgggctctcttgaaggttaactgtgcccagcaccttgacaagccccatttcctccagtccttaggacaaggcatcctttgggggcgtcaccaagctgggaaggtgagcccccgagtcagtgttgagtttgcgtatcggcaagtgccttgagctcacacccctggaactggcagtttggtgagagatggaatttcaagttgagaactggcctgggattttgaacgcttagtccctgtctcttgctggcactgctgctgatgagaaatgaatgtcactggattcctgatccagagtccaggtgttgtgtttctctaagagccttcaggcttttccttgctgatctaaaactgcttcatgtccctggtgatgcttttgcattcattatcttggctacttcctaggccctgttcttgctaatttgcttgtattatttcttttacaatttctttcttttgttttctgttcttctgttttgggatttctgttaattgggcattataccttctggatttattctctaatattctagtttttttcttctgtctacttttttaaaccttctgggatatttccttgacttctaacccttcagcggagtttttcattttatttattatagtttttaaccttttggttttgaaatttttttttctttttttgagacagagtttcactcttgttgcccaggctggagtgcaatggtgcgatcttggcccaccgcaacctctccctcccaggttcaagcgattctcctgcctcagcctccctagtagctgggattacaggcatgtgccaccacgcctggctaatttttgtatctttagtagagacagggtttctccatgttggtcaggctggtctcaaactcccgacctcaggtgatccacccgccttggcctcccagagtcctgggattacaggcataagccaagcccagcttttttttttttttttttgagacaaggtcttattctgtcatccaggttagagtgcattggtgccatctcagttcactgtaacctcgacctcccaggctcaagcaaacttcccacctcagccctctccatcccccagcagccaggactacaggtgtatgccaccatgcctggctaatgtttgtatttgtagtagaaatagggttttgccatgttacccaagctggtcttgaactcctgggttccagcagtccacccgacttggcctcccaaaatgctgggattacaaatgtgagccaccacacccagcctttgttttgaaatttcaaacttacctcgttttaaacatcttgacacatttgcttatcattctccttctatttctgagccctttggaagcaggtttcaggcatgatgcccttactattttagggtgtgtttcctaagaacaaggatgttttcttctataaccacagaacagtgatcaaaatcaggcaacatcagtatcacactgtttatccaattgacaggcaatgatggcgtggatcatacaacttcggtaatgacacttgtcccagaaatgtcctccgtagtgtgttttcctcatctaatccaaaatcacgttataacgttttgttgtcataaacttttttttttgaaacggagtctcactctgcactctgttgcccaggctggagtagagtggcacgatctcggctcactgcaacctccgtctcctgggttcaagcaattctcctgcctcagtctcctgagtagctgggattacaggcgtggaccaccacacccagctatttgttgtatttttagtagaaatgcagtttcaccatgttgggcaggctggtctcgaactcctgacctcgtgatccgcctgcctcggcctccaaaagtgcttgaattacagcccggccaaactatcatacttttaattcccaaggcctctcttgttctctgcaccatttcattaactataggcaatgagacttttttagaaagcagaccaacttgaatgcatggagctgagtggcgtggcgttgtccccaagggagctgggtgacaccacgatggtgaccatgtgcagagcccttctcaccgtagagtgataaatggtccgtttctgttttgtcccagaagtcagaggtagagttaattcctttcctttccccagcacggttcctggcacacctggcactccctaagtgcctgtgatggttggttcttacgtgactgaacttgcgggtggacgtggcattacacgtgggcagggcgtatgtacacctgtgtgtgtgtgtagatgcaggttcgcaggggctgggcagaggccgccacctgcagacctgtgggctcgttcacgccaggtgtccatgtctgtggtgtgcccctgtgtgtaagtccagctgggctgtagacagccatctcttctctgaaagttgatctgttcgtcactctaagccccaagcagccaggggctcatgggattttcatgaacactctcctcctgtcccctgcatgtgcaaaggtcctggggctcaggggttggaggctccatcgccccagtggttgtgaggcatctgggcttgtccagacaccttcgcttctgccctcggggtccctttggggacttttgtccttgctggggtccagagttttctggcaaggcctagagccctcttcctcccctccccttccaggcacagccccccaccagcaccttatgatttcacagaagacaaaagccagcagactgtgtgggctgtctgccctgagagttccaaggcgaggctccggagcagccagccgtgaaccccaactgcagttcgggaagctgctttcggggaggggcagggaggggagggggattctcggagcaggcaggcagccacgctggagagcccctccccaagctcttcattccaaccctgccctgccccctgccttgccgatggagcctgtcaccctaaacctggcctcagtaaaccaacccaggccagagaaagagaagtgcggccccctcgcccgtgtaagtggaactgcagcggagccgatagctcagccatgaaaaaatcatgaggtcgccaggctgcaggtctgtgctcaggaataacacccggggctgggcccctgggagtaggtgctgggccaggagtgaggacatcaaggcccggtgtgcccagcagggtggccctcacctggctgcagggccaaggggacaacagagcctaggcaggggcttggcacggggacaagggggagggtggagtacctgggaatcactggagacagggatgccaacaggagtggcagcggtcagggcctggcactgaggtgggggctcctccgatgcctgcagggagggctgcaggcactgctggcctgtgaaaggcgtggtcctcagccgcggggtggccccagggctccatttcccagttttcagggctccagtccagcagggcgaggagccacctctcccccagctgcacacacgcaggcctgtgccagctcacaccaccagcatcagcgttgcagggcatccagcctggagcacgtgccggtcaccatggcagcagacagcgtgccagcaggagcccaggctgggctcaagcatccaggatcagtggtctaggcatggggggcttggggtccttccccttggagcaccagacgggccaactcggggaggggaagggggaccctggagcaccaggacagcccgtccaccagcacctcagaaagggaacgatttcctaagggctctcgggaaacctgagggtggacaccaggtgccggtgggggcgcatggcttcctggtcctgcccagctggccccgcactgagagggatggaggccgaggctcaggcctcgggaggctgccaggggattctgatggctgaggcattccttgccctctgggctcaggtgaggccaggaagtctgtcacagctggctgctccctggaccagggggctgggggtactgctaccccaaacagcctctcactgcccaccgggacaaggcaccccctcccaggtgcagacctcagcttgggcctcaggcacacactgggcaggggcttccaccagcctcagaggtgggcgagggtggggcgtggagccctcagtgtggcagcgcctttgaatgtcgccacagtgcagcctgcacaggtcagggtggcaggcacgtgtgtatcccatgtgagtggttggttggcacctccggaggtgtggccacagggcttggtgagggtcagtgggaggggtgcttcctgttgcctgagaacactgcagggggctagagtgccccagcccaccatatgctcttgtgagttgtgtatgtctggagtatgagtgggaccctggaaatagcctcccttgggcagtgtacaacctgggctccctgctgggcagccctgagtaggctctcaggctgggatccaggatgacagtcccagggtccagagttggcccagcaggcgactcttctggcaacctttgcccaccctcatccatgagcaccttcacacacacacacacacacacacacaccacactcacacacatgcacaacgctgcacccatgggcagaggctcagcccatcatacaagaacccggccctgtgctggggtcccagctgctcaggaggccaaggtgggaggatcgccggagcccaggagttcggggctgccactggccaagatagcgccactgcagttcagcctgggtgacagagcaaaaccctgtctctaagataaataaaaagaaccagacggccaggcacggtggctcacgcctgtaatcccagcactttgggaggccgaggcaggtggatcacctgaggtcaggtgtttgagaccatgctggccaacatggtgaaacctcatctctactaaaaatacaaaaactagcggggcgtggtggtgggcgcctgtagtcccagctacttgggaggctgaggcaggagaatcgcctgaacctgggaggtggaggttgcagtgagctgagatcacgccactgcaccccagcctgggcgacagagcaagactctgtctcaaaaaaaaaaaaaaaggctgtgcctggtggttcacggctgtaatcccagcactttgagaggctgaggaggccagatcacaaggtcaggagttcgagaccagtctgaccaacataatgaagccccgtgtctactaaaaaatacaaaaaaaattagctgggtatggtggcaggcgcctgtaatcccagcaactcgggaggccgaggcaggagaatcacatgaacctgggaggcagaggttgcagtgagccaagattgtgccattgcactccagcctgggtgacagtgtgagactctgtctgaaaaaaataaaataattaataataaccagactcccgacatccaacaatctcaggcacttattaagtacctgctgtgtgccagaaattttgctgagaatccagaggaagcgatcctagcaggtggctgggcaacagcctggggtcctgaggtggaggcaggaggggctggaatccctgtaaacggcctccctccaaggaagcctggcccaggcgcccacccttcagtcaccctcccctgtttagctcacacagctgggtcagtgccaggcagccccacccaacgtggagctgtggggccctagaactgaggagccgccatcatttctggctctgccaccaagaggctgcccagagccaggcccacttagtgccgggcggccaggcttccccctgctgagcacccgatgcctaagcgccctgccagcccagacagcgctaatgaggccgtcgtgccaatcagaggggcaggccgcctgggctcctcctcagcctggctgggcgttggggtgtggaggtgaagccagtgtctgtgcctggggtgggggggaccatgggcacagctgcccctccggcttcccccaccgctcacggaccaaccgagctgtaccctcaaaatccaacgggaggccgggcgcagtggccacgcctatcatcccagcactttcagaggccgcggcgggcagatcacttgaggtcaggagttcgagaccagcctgggcaacatggtgaaaccccatctctactaaaaatacaaacattagccgggcacggtagcaagtgcctgtaatcccagctacttgggaggctgaggcaggaggactgcttgagctcgaaggttccagtgagccaagattgcgccactggactccagtttgggtgaggagcgagaccctatttcaagaaaaaagttttttaaaaagaagagccaatgggaaagtgaggtgcaggcagcaccctagcttgtatccctaaaccagagacagttccctggcatcggtgctaggcctgtgtcctcagtcccctggaaactgtgggagagtgtgtgtgggcatcgtctctgggaagggggtgaaaccccagactgcgtctccccaggatggtgcctggcacgtgacctggtttcgcacacagttggtgcctcataaatgcgtgtgaatcatagaggcggatgaggccagcacacagggagaggcgagagcaggccctggcgtcgtggcgtacgctgtgccctggggggtatttgcatgtgggagtctctctgcccccaccctggcccctgagcgtggggacagtggggacaggtctcctctttttcctcccctgtgtctgcaggtgcctggcacggttgctgtccagggcttagaggacagaggaagagcccctgagtctgtgcacactctgccaccatggccctgcccacctctggagcccacaggtgcccagcccaggccccttgcttttggctagactcctgccctacggggacccccatgatggccactcaggagatgggcccaggaggacaggggagtgactccaggccatgaccggaaggggcctgtggcccctgttcccagtccccagggagacgggagggtcacacgctgttatgaggaagaggacaccgggctggccctggcccagggtggccagctctggtttcactacttggccccaagcccctgaggcaggtgcaggagccaggcacggtgagcagggcccagtgcccctcaggctctggggaaggggtacagccaggtggcccagagcaaggaggtgctgtagacaggtgtgaccacttccagtctctcccggcctgctggccttcatcctctcccagattccaagggccaccgctgggagcatggggtggacatcgtcccaccagcctcctggatccacatccgtaaagactccaaagtgaagtgaggctggcttcactccagctcacagcagaggagggggcagcctcagggcccagcaacttgctcagagcgcacaggagtgcgctggggccgggccagcctggcccagggcctctgactctgccccctgcctgcagggctgcacggccactgtgttccaccctccagcgtgggtggcagtccagtgcgtcattctggggcctgagcagtgtggccagaggccggtctggggtggaggcgacctgggctgcaggttgtggctggggtccttgctatgcttctggcagcaggaatcagagaagcagtaactggatccagctgagggcctggcggccaccgagggtacgggcggcgatcaggttgcggccgagccgtgagcgttccactggacggcttctacatccggaagggctgggccgggccgggccgggagcccacacggggttggaggaggggggcaggaacgagagaggccaaaaggtgcagggccgtgaagaggggcgctgggcccacgctatgaggaaaaggggatcaaccctgccctccagccccgtaggccctcaggccctcgggctctgggctctgtgcaatccgggagtggctgaaatccaagctgagggtaatgaaaggtgctgctcctaagccgcacgtctctgatccgccctccccgcccgccctctgctgcccgcgggccctctaagagctgcccaggctgctgccgcgggtcagaggcgggtcagagcaggcagggggttcgtgacgccggctgggtctgggggctgtgggccagccgagccgacccgggcttctgggggaccgcgggggccgtgagcactcagagggcgcatcccaggcccctccggggacccggccagcctgaagatgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggtagggagggcacaggtggcgacctcctgaggggtgctgggacccccctgcttcagggaggaggccgtgggggtctcacggggagtggtatcgtgtctgtgcgttcacatgtctgttctgggctgggggtccatgtgggacatgtgtggccactcagggtgtaggtgggtgggcctcgggccatgcccaggcgacccccactgaggggtggtggcttcagggtcagaggcaagggttcctggcctttctcagcatagctggagaatgtctcagccaagccctgggcagctgcggagtctgagactggagaggtgtgggccaggcgatgggcagtgcccagcaggggcaggaggcccacagcctggcctggtgccatgaggggcatgtgggcaggaggctgtggggggtccatatctccccttctttttctccaccccattttctggacttcatttatttatttattttttgagacagagtctcgctctgtcacccaggctggagcgcagtggcgtgatctcggctcactgcaagcgccgcctcacgggttcacgccattctcctgcctcagcctcccgagtagctgggactacaggcgcccgccaccacgcccggctaattttttgtattttttagaagagacggggtttcactgtgttagccaggatggtcttgatctcctgaccttgtgatctgtccacctcggcctcccaaagtgctgggattacaggcgtgagccaccgtgcccggctgcattttctggactttaaaggaaattggggaggagcccagggtagggcagggagctggggatcgggcggggatagcaccaccacgtgcctgaccagtggagcctcgtgtcctcaggagtgggggggcttaaggtcagctccagtgatggaggacacggtgggcaggcagctttacccggggcctgggctcctggtggggaggcacctccctgccccagtggggcgtggcctggctctccccagttcccaggtcaccagttgcctgtctgtgtgactccctccaccgcctatggggtgaaccccagcagttcctccttccccacaagctgagctctgagggaaaagccctggcccgggcagtcactacccacctgggctcctggctccatgcaccccagagtggctcggaggtggtctgaaaaggcgaggtggggagagccgggtgcatggagctcctcctcccaactcaggtccttccagaccagcatcagctgggcaaggagagctcccctgtctcctggcagctcccaggtgcccaccaagcccccaccctgacggatgtccaggccccctgggtacactgacactctggggccagatggcagaggccccaccctgtgcatggagaggggagcccagccatggctatggggtcctgcacctgcagttggcatcctcgggcctgtcccagcagtgacagggtcccaggagtgagaattcaactgtggatgcacggccatggcccttccttcctatcacagcccacagtccagctgtaatgcctgctggcctgggcccaggccgggcatgtggcaatccttaggtggttaaagggggtaagtgggacagtggcagtgagaatgcttcctccatggaagccaaagacactagacctttaggcatttgtatatggacagcttggaaagcagactcaaagtggcagtcatggccgtggccgtggcattgtggtgtgatgtgcatggtggcgtggaagtggaggtgaggacggtggtgacagtgtggtggcagcagcgacaatgatggtgatggtgatgatggtggtgatggtgatgatggtggtgatggtggtgatggtggtgatggtggtgatggtgataatggtgatggtggtgatgatggtgatggtgatgatggtggtgatggcggtggtgatggtgatggtggtgatggtgatggtggtggtggtgatgatggtggtggtggtgatggtggtggtgatgatggtgatggtgatgatggtggtggtgatggtggtgatggtgatgatggtgatggtgatggtggtggtgatagtgatgatggagatggtggtgatggtggtctccatcaccaccatccccatcaccatccccatctctatctctaccatgcccatcaccatcatcaccatccccatctccaccatccccattaccatctccaccatccccatctccatccccatctctgccatccccaccatcaccatccccatctccatttacatccccatccccatccccctcaccatcctcatccccatccccctcaccatcctcatccccatctccaccatccccatctccatcaccatccccctctccatccccatccccatctccatcaccatccccctctccatccccatccccatctccatcttcaccatccccaccaccgttcccatcacctgcaccatcactcccaccaccatcactgcctcggccatgaggattgccgtagcagctcagtcagaaaggaaagcccactggggcagggtagcgcctgatggtggtgggtgtgtcagtggagggcaggcttctgtcccactccttggaacctgaggaggatggggaagtgagaccctgcacccccatctcctgctgtcctgaggagaccttttgctgctccctccagttctgccaacaccatgtttgagatggagtggcgtggccggcgggtagcactcaaagccagcaacgggcgctacgtgtgcatgaagaagaatgggcagctggcggctatcagcgattttgtcggtgagcactctgcctgccaggtactggggcaggggctgtctccacccagggaaaggacctgcccagacaccccatctccaccaagagctggaccctccccagcccacggaacgggtgctgtcatggagtcatacttgctagtcaagataactcgtcttggcaagggaaacaggtctgagtgtccttatctccgctgctgggaaccccctaggcgccttgccaaggccgcacatgaggcaatggcaggcctgggtccctaagtccaggtgtggcgtttcccagggcccccaccccgcccggcctggacagggaaggtggcgggaggggcagcgcagcagacgctctccccgccaggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggtgcgtggcggggcgggtgggcacgcgggagcgggggtggcagcgggcaggtgggcacccccgccgacgccgtcccgtcccccaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactgaggccgcgcccagaccagcctgtcgcgcattaaaaccgtgtctctcccgcagctgtgggtgggccccggggcgccgcttgggggtcctgcagctggaggtggaggaggcccacaattctccccaaaccagagagagcccagaacttcccagtgcccagggactcccgtctgggaggtggtcttgtggatgggccgggtgacccaggccgctggaggggaggtctcaaggacatggggaggacggggactgggggtgggtgggggactgagcctgcgcgggttgaggccaccaacaccgaccacagatgacctcactggacaccgcccctccccaacctaggtcctcaaccctccctagcccccggcagcccctgcggtgctcgtccttccttgtgcactgctcaaggccaggcgagtggcagagggtgggggagagccagtcctggggaggtgggaccagcacggccagcaaggggaggaactggctgggatgcccctccactaagcccaccagccttagggacaaagaagggcaggtttccatggtaagaggctggaactccccgagccacgtgggcaaggcgggtccgagttaacccttggaggaccaggtgccacctggtccaagttggcagggaacggcagtgaccctggagctcgggctgtccctgcagcctgcagtgtcccctggtggcagccaaggtgaggtggagtctgtggctggggcaggactgggggcaccaggtggaaccgcagtggctggcactcagcacctccaggctccccgctcagcagagcctcggagagggtctgtctccctgcactgccctgcctgacgtgaacttggcctgccactgcgggaacccccacttccgtccacatccacagcctggggcacggcgggaggcagaggctaggaagcggagggtggggtgggaggtcaaagaaaccctttggaacggaataatggctgggcctggaagcggggggcccactgctgctgctgaggcaggtgctactccatgcagagacagctgccagcagctgccaggtggcgtctagcacatgctcctaggaggagggtgaagaacagctgctctcaccccacgtgtgagctgggttgagggtcatgcaaggctacggtgtcaagccaggatcggagttggagcaggtggaggaagctggaaaggtcgagaggccgcccctgccaccggggaagggcctcacgtagtgagagctcaggtgctgagagcccaggaggtgtgcactgaagaggtgagggcagggaggcccaggatgggcgacagggcccggccacaccgtggtccgcaggctccccaagaagctgattgtggacctgccacctgcctctgaggccaagccctcctcaaatgccgagtgttgagagcaggttccttggaggtgcatgtgagttgggtacatttcgcccagtccctgtacactctggcggcacagcggggctggggactgcccactgtggtccctcctttcctgccgctgtagatctcctttttgttccacgtgacctgctctcttggcccctcagggtctgcgtcgcagctttcttttcggggggaccacatggcgtcttgaactaggcgtccccacagcaggatctcaggctggcaggtgggcatgaacgtttgtaaacacaccagcactgatgcctccacatgggtggccctggagaatgccccaacagaggtcaggacagctggggacgccgtctcagccctggtggccagcaccgctttaggtcaggaggctgcagtgccaaggacagcaagctatctaaacccccagtgtgtgcccgggggtgtggggacaccagtgcggctcatccctgtgtctgctctttcacaagccacagtggtgcccccacaccccctgcacagctgaggctgacagggttggatggtgccactgctctgcacagacagcagccccgtggaaggcccctcaggctcccagcctcctgagacctgctggcatccagctgagggtggggagatgagtcctgcaggcgacccagatctgtcagctctgggatccctgtggcctgtgatggcgagtgaggggctggcacagccctggacacacacccctcccccaggcgtgtgaacacagaccctgcacagtcctccgcccgctcatctagggccttcttgggagtccccacgggctggtctagcccctcactctccgagccctgatgctcagagcaagacacgggcacaagcgctgtacaaaggtcagagccagaagctcctgcccacgggtggcagaggacagccctggagcacagcagggatgggaccgttaaggggtgcaggcctgcctcggtgggtggctcgcttggccccagctctcccagcaagcacggggccatggccccattgaaaaggctgggtttggagtgtcaccacccactgaaaatgctgggtttggactgtctccacccgctgaagaggccgggtttggagtgtcatcagggcggccgtgctcccttagatgtggcaaccactgagggagacaaaccctgactaggagcaccccacaggcccctcccactccacagagaggaacgcaggggagagccaggcaggggccccaggcctcccagacacccccttggagcagagccctcctcaggggtaactgggtcacagggacgcgtcttcctcggaggccaccccggtggtgagggctcccaagcagcgccagggctctggaaggagcccagtgagagagggtgggaaggggcgagagaaaacagccgaggcctgaaggttcacggacagacagggtcgtttgtcacagcagagaagcacctcacggctcctacccgcactcatcgcggacagtgcctgcagcgggagcggcgcgagcaccctccccagatgaaaacaccagcaccaggaggtgggccgtagcccaggctgagggaggaggctgggggctggggctcagggcccccccccggccacagcgccaccctgagtggccctgaaaatagtgcacagtgctgggtactgccccggccggaggcacctagttgttgagcattccggccacaggccacccgctggcccttccttggtgtggcacgagaccacgggcacttgcaggagctccctgcatgctgttttgtgctttggtctcagggagcaccctcctacctcggggtcccagagtgggcagccgggcaggtgtgaacagtgtgacaagggtaccgtggggcacctggtagtgccacccagaggggcagccggtgctcctggtggtgtggcagcaacagttacaaactcaccccaagtccaaaccccagaaatcctgtttctctggccctccgggtccagaatgccctgcactgcctcctggcctcaggggctgctgcggtggtgggaaggctgcccagcagtgaggaaggcgagtgcaggggctgcggccgcggtcagagaaggagagacaccagcagaggacgcgaagctggaccggccaggttcagagcccgcctcggttgctcccaatcagaatctgctttgtgctccacggcctccaagcactttcatgagcgttctgctcctacgtggccaggtcctaccttccctgacggctctggccaggccagctcggtttccctctaacccatgaggcctgggggggctgtgacagaggctggaagcgtggccagagcccaggggcaggcccgcctggtcacagcaggatgaggctggggtggcgcagctgccggtacacctgtagcagcctctgggcggtggcacaggagctggcctcatcctccgtgcagagccggtcgcgcagggtctgcacctcccgcagcagtgtctgcaggtgaagcagacacagctcaggccccccacctggccctggggatgtcactgggtacctctgggggacccaccactcgcaggaccctacttgggaagtggcaggtggtccgaggaagaacactcatccggaaccttaaaacatgggacacgcagcctggcccggacacccagcccctcaagtaggatgaggggcaggaagagccatggccgctcggactttgccccaggcccatgggagcgaagcccatgcgctgtgaggactctgcggaccccgagtgactggaggggggcctggcgatgggcgctcctggctacccaggggaaggggactgcccggggaaccgggtgctcacctcgtggttggcgtggatctggcggaggtactgcacacggagatcaggagcgctggagccctgggcggcctgctctgtcaccatcgtctgggggacacaggagacatgctggagagggtgtgccccagcacctgcccccacaccccttgaagcagggtgaccctctccctctagctgcctggtgctgcctccctgcctggcacccctccccaccccagcgctttgctgttttccaccttgctgttcatctcgacttcctgccctccagagcggcagggcacagagcccctggcctgacagtttcttggaagcgaactcgtttggttcttttctctccatcgctgggatcttccctgtccccaagagccacactctgtgcagatccagacctgcctactgcccccttctcccatcctgggcttcaggcctgaaggccgctcaggagaacagaccagccagggagctgcctcggcgtcttgtgcagagaccctggcctggccattcactcattcacgcagcccagcccagtgtgggctgcagcactggctccctgggcttggatctaaattcccagatgggaccaggtgtggctcagacctgtaatcccagcactttgggaggccgaggcaggcggataacttaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgagcccgggaggcggagcttgcagtgagccgagatcccgccactgcactccagcctgggcgacagagtgagactccgtctcaaaaaaaaaaaaaaaaaaaaaaaaatatatatatatatatatatatgaaatcagccaggcgtggtgacagagcctgtaatcccagctattcgggaggctgagggagaattgcttgaacctgggaggcagagggtgcggtgagcagagatctcaccgctggactgcagcctgggtgacagagccagagctctatctcaaacaaacaaataaaactaaatttccagatgagcctgggcagtgaggctcctgcaggctcttggagcaaagcaactgtgaagagacgacaccctgaggggcagcactggcctgccgggggctccagaagtgctggtggctgcactgtgtgctgggcagggtcctgatcactcctgttcctggggcgggcacctagctgttgggggacactaaggtctgcagcctgagatgagatctgtgtccaggaggcagcagcagtgcatgggctcctgggcgctgactcaggccccccagattcatgcggaagccctagtgccagcactcagagcctggctgtgtctggaaatggggtatctgcagatgatcaagatgaggtcactggggtgggtctgaccccacacgactgtgtccttgtaagaaaagggatatctggacacaaacccaggggctggagctctgctcttggcaggggatgggactttcttggggaccagatggtccagtgggcagagtttcctctgacaggcaacacctcagctctggagaaccccctggtgcccccagcactcaggactagacccccaagcccaggcagccccatcgtggtgccgtgagatcactggggtcatggtgctgcgtgacatgctcatcagggtcatggcagtgtcacagtgcagggcacagggtccttgcaccaaatgagatctctgggtcatggtgctgcgtgagttgatgtgttcattggggtcggccatctgagccacctgccagggctgggcagagccactgttcacagaaaggcctggtctccaagcattaccacagtgcccacgggagtcaagctggcgtcaggctgcaggccctgggtctcagggttgggcaggcctgggcatgcacgttgataacaagcccaggtggagctgaggcagggaccacccctaaaaagaaactccggaaccggtttctagggtcgctgcagacccaccatatgggccaaagctgcgctacagtcctagcgggcgggcgtgacggatgccttcccgcgggcacgagcttagactttagcttggaacttggagagcttcttctcagatctggcagccgctgacccaagctggctctgggcacagcatggaagcagctattcctgtgccagggaactcctggggctgtgagtggggggaactgcaaactccactctcttggcaaagatgtggaggctcctaccacctcgttctaggatccacgcccaggccacggcctctccaggcagcctctgcccagccagagaagggaggaaaccttgggctgacctcgcaggtcacaaatagaaacccactggccttgtagcccgggcagtccttggactcacaggtgcccagggggtgacggcacacctggggagcagcattggcctcctgagagggtccaccccatgcctctcatcgcccacagctccactgcacaacaccgcactcagcggcagagcggacttggatcttcctacaactcccttgcagggagccgcagaccccgtggccagcagctacagggtcccatgcagggaccttagtgagcgacccacagatcctggccaccttccccagcgggccgacatacctgcatgcgcccgacaacggcatggtgcgccctgcaaatgtcggccagagaggagctttccacttgaatctccacggcctggatgggccctgctgggcacaggtcggtcatggccacctgcaacacaggagccacctcactgcctgcctgtggcactcccacctgcccggggggctcaggctacacaggagcctccccagctggcagcacgtgaggccctgagatggtcccaaccccctgccctgggctgtcctataccctgaaggagcagagctcagtaccctggtttagctttttccacctgaagaaccagccaccaaccaatggcaagaacctgctctgtacccagatgtgtccaggaagacaccatccctcagacctgtggaattcacgcagggcctcgagccagactggggcctgctccagaagaaggccactactgtgacacaccttgtggacaacctacatgtagatcctgccacgcccttggggggcccagatccgtccccccacaccaggcatcacagatcacctctggcagcagggttagggcatcgctgtgggcactgggagctgctgggcctatctatgggacacccacctgtcccttaggaaggttggactgagctgagatggacaacaaatggcaagaacaggccaagagccaggaagccgggcttattctgcacacacagcacaagaggtgagacgccaggggcctggggagcccagagaggacacagtcacctgcggctctcccacaggggccgccagcaccgacctgcagggccaccaacagaccccagcatcagggctgaaagggctgtgtagagggcagccaaggtacccgagggccgaggcttgattccaagtgcagactctgggccgggcacagtggctcacgcctgtaatcccaacactttgagagggtgaggtgggcggatcacctgaggtcaggagctcaagaccagcctggccaacatggtgaaacccccgtctctactaaaaacacaaaaattagctgggtgtggtggtgggtgcctgtaatcccagctactcaggaggctgaggcaggagaatcgcttgaacccaggaggcagacgttgcagtgagtcaaaatcgcaccactggactccagcctggagacagagcgagaccttgtctcaaagaaaaccaaaaccaagtgcagactctgagccccaggcagccttgcccatcctcagggacacacgtgtcctggcagcctgggctaccctgcaagcgcctttgctggtgggacttgagagtgtgctggaggcaccacagtcctgagtctctggaaaggtgtgcacgacaggggctggagaccagcagtgccatttgccattcagcggcttccacgacaggtctggagccttctggcagtgcagagggttagcggggctgctgctcctggggtagaggtgttggtggcagcactgtggaacccgctatgacttcagtcctgtgcaggggaaggggacccccatggcagacagggatggacagggccagtccttggggatctgagctgcaaggccctccctgcctgagtggggtctgcttggtgcgaggggaaactgtcatatcagagtcctccgggaagcttgggaaaaggctgccaggcccccacccagggtgaggggtcctcccgagctccggcccaggggccccaccccaagaactgctggtgccgtggctcgtttccctgaacccctgcttgcctctcggacgatgaggtgaacgttggcgccatcaggggccactccctggatggaagatagtgctcgggccctcacgacgtccacagcagcattctcagcaaggagccactgcagggtggcacagcacaggggcacgcctggaggggaggcatcagccgagagctcagcctgatcctaccaggtgggctcagccgatcctaccaggtgggcatctgcatacctgccccaaagtgcccttcccagagccatctaagcatcccagctgtccccagccccaccctaagctgcggcgtggccagctgacccagaggaaggaggccactgctcaactttctctgctgaacaagtcctacgatgggtggtggcagttacgatctgtggaaggtgaaaacctcactttgggggacctgctaatgctcctgggagccgatgttaggagcaggcagctccgcccggcactgggcagaaacaccccaggggatggctgcggctgccctctctgcacaagcccaaatccagaaaccatccaaatacccatctgcagcagaacggtgacatctgcacctgcgacacagagggtctcacacacatgggggagcaaaggacagacacaaagaagggactgcacactccatttcgtggagctcacacatgcctgatgaacggtgctggggctttggggtgagcgcagctgcctccctccccgggtgcccgcactgtgaagctcacagtttgctcctttgtgactcttctgtatttaggttacgcttccatatataggtttaaaaaacataactgaaaagaaatacatggtgagagggctccacataaggccagagcccaacagcagagagaacgcaggcgaagctcatttcctgagcagagctcgctgggctggggggccaggatgccccaggagcagctgggagagggaggaacagcccatgtccacaggcccgaggtgggtggggtgaagtggctcatgcaggtaatcccagcattttgggaggcccagaggagatcaattgaggccaggagctcgaggctgcagtgagccatgattgcaccactgcactccagcctgggcaacagagcaagttcctgtctcttaaaaaaaaaaaaaaaatccccaaggctgagcaaagccaagcagtgccaccaacctgagtggccgtccttcaaggcagctctgagcagctccgccgacaccttgatggaagccacagatgggggcaggtactcggcccgcagggaggcgggtcctgctggctggctgccaggctcccgacaagtttccagaaaagtggccacagggtctcgggtggggccgagtggggagggggcccgtgtgtgtggcagggccaggccagggaagcgcagacactgcagcatgtccactgtgtgcctgctcaggggcaggcaaacaccctcttgctcgggcaggacgtcggaggggcactcatccagaaaggggtcctcagagtctgagggggcaagggccccgcccaccacctccctgagactgtagaacagcgtgcaggacacggtcacgggcaggtcgagcccgccgttctcaccagggcccaggggtagcgtcacctcccgccgagcaccggggccgagctggtccacggggatggtgtaggtgatggcggagcaggccgagtccaggtcgagagcacaggagctggtgagcacctggatgcacagggtccacccctggtccaggctgaagctgctgctgttctctagcacgcaggtggccatgagcacatcctgtgtctgcaggcggctccaggtggtgctggtggtgcaggagatgggtctggggcccgtgccgcttgacagcagtgcacagctcacgttcatggcctcgttgaggcttgtcagtgccttgttccgctggtcaaccgccttctttagaaaagacactctgcgaaggacagacatgacccccgggagcggggggacacccacagcaccaggtgccacatcttgactcaggcctggtaggcaccgagcctggctccacgacaagcacacggtgggtgtggagccacaccagagagtgagcccccgccccaggggcatgtttctcccggccccacccacaccgagcctctctggaagctgcctccagccatctgacctgacctctcctcttgggccacaggaggaaagaggacagaggatgaagctggtgctccggggacctaggctaatctgccaggtatgagaagcgcaccacccacatctgggccacgcaggggccgggtggtgcattaccccacccttggctccccggaatgttcctagtgggcctcttttctcccttgcagccttcacagtgaaaaccaggggggtcgcaggcgctacagaaacagccctaaaccacagggacccggagtgacaggcccctcgctctcgggaccccagtggttatgtgaggggagcaggggaggctgcgcgcactcagtgtgttctctctgaacgtcccgaagccagtgctgcgggaggaaaagcacactggatcctgtgctgagagcagggagggtgaggactcagcaggggacgtctcccgtgccccactagggagaaagggtgggctgctggggggcagtcccggcttatcttccagaggtagccaggtagcctgtcaccaaacagtgggacgcatgaggctctcaagacatcttaagaggacaagtaacggccgggcacggtggctcacgcctgtaatcccagcactttgagaggccaaggcaggcaaatcacctgaatccaggagttcgagaccagcctaggcaacatggtgaaatcccatctctactaaaaatacaaaaattacccgggcatggtggcaggtgcctgtaatcccaaccactcaggaggctgaggcgggagaatcacttgaacccaggaagcgaaggttgcattaaaccgtgatcgcaccacaacactccagcctgggcgacagagtgaaattctctctcaaaaaaagaggccaagtagggtcgggcccggtggctgacgcctgtaattccagcactttgggaggctgaggcagacggatcacgaggtcaggagatcaagaccatcttggctaacaaggtgaaaccccatctctactaaaaaataccaaaaattagccgggcgtggtggcgggcgcctgtagtcccagctactcgggaggctgaggcagaagaatggcgtgaacccgggaggcggagcttgcagtgagccgagatcacaccactgcactccagcctgggtgacagtgtgagactccgtctcagaaaaaaaaaaaaaaaaaaaaagaggccaagtaatggcctggcctggaccgttgccacccgaggacactcacacccaggacgaccccacacagggacgctacctcccaaggatggcagcgccagcctctacccggtccgagctgagctgctcacctctcagagatgttgccaattccagacagcagctcctttattttctgacctgcactctctgtggtcatcctggctgggccaggcatctcagagtccaggtccaggctgcaggtcatcaggcggcctttggcggacagggccaggagcttggtgccacctggtgacagacacacatggggcctggtcagcggctgggaggggcaagcagcatgacactcggtggtgtttccctggactccaggaaagaagttggaagacggccaaggccagtgtccagtgaggaagagaaagtcccaaggcaaatgcactgtcccgaccctgggcttctgtcagtggccccgagccacgccatctctgatcccacccgtagccctctcttccgcagtggagacagtctggcgtttcccttcaaagcccttctctcctgctgtgtatgtattttctgtggcgagatttattagcatgctcacaaggtgagcacacttggggaagtgcactggtaggaggtgtgtggctctattcctctcaccccaacactgggcacacacagctaaaaccctctctggctttttctgtggaaaacacaaaactagaattccacaatgccatctgcctttggtccagagcagactcacgggcaagccacaccatgacacgagcaagcgtttgcagcctttggaagaaaggcaagtccggaacagacctccctgggctgcttgccacataagacctgcccaggaggcgcttgcggtggacccccaagatgcagtttcctccaagtccacagccagcaagcagcaaactcagatcctaccaggcccagggccacaccctagaccccagaggcagagcaacaggtaggcccaccaccagcccctggcttgaccttgagacaagagagttaaccactaggctgtatcagcacccgtcagccttgcaaaagaacaagcccaggaaaggaaggcggcctgatagtagcagacagccaaaaagggtgctccaccctgggctcccatctttcattttagacagcagctcataccttcatgcgtcctgggagacgcggacagcgagacgacactgcagatgttcaggctggctgggcacagcatggggggcaggcctcccgggccttcttcgggctgctcagggcccagcggggtgcttccccgagacagatccaccacacagaggtcagaaggggtgctgtggtacacgcggccacccccgccacaggcagcgcagagcacagggcctgggaggcagtactcccgcagctcgggcaccagcttcccggactcatcccagctggccttgatggccagcatccggccgtggtgaccaaaggccaccaggcagtcacagtgcacatcctcgtcaggcagaaaattctctgcagcttctgcagcctgtggctctgtcttcaaggcccctatgaagatgacgggctcctccaggtgatggaggatcttgacaagggcatttgggtcaccaggggctgacctggaggtgaccagggccttcaggatcacacagcagagctggccatcagggagaccacagaggaccacaggtgactgcaggagggtggcatcagctccaaagaggagcccgaagagggcgtcctccagcgtgaagcccccggagcccccgaggaggtcgtgcgggaccctggagcctgatggtgacacagagcacagcactggaaggaagtggggggctgcaggctttcctgggaccccggctgggggcgtgtaggaggacagctccacctcaccgatctggcctcctggccgggggtcctccccaggacagggctgctcaaacagctgcatcttccatcgggcagggccctgcaccagggtgaccagcacactgtccagcaaggtgaacgcgcacagcgcagcatcgggaaggatgcaggcatcggggtccacagggatcacgggggaaggctggtcaccgtcctcgctgtccctgtcatcctggctcgtagacctttgagaacagggacgcactggtcaggcctgggcagggtgggattcccacgttctcttcacaataacctggcatggagtagtctggctcaggggttcccgcagtgacccccaaggccgctcagcagtccatctgccacgtggcctcccaccttccccacgaaggatactcttgacaagaagtaccaggcatccaaaaccagcgtgaaccgacacctgtcagcatagaaccgtcaggctgaggcccaggctgcaaagtgcacaggctgccccctctacagcctgggccgcggtcagcagctgctggctctgcactgaagacaggcctggctgcccggagctcgcttccttccaacccagatggtgtccactgatcactgactcggggtcacggtgcctttgctgtctcctccctccaataaagacccaacctcgggggcgtgtctcaccagacagcaccgggccaccagggcccaaaggacaggatcccgcgccccgccgtgggcttaaccatgtgaaccccacttactaaggactgtgagcaagacacttgcagaaagagtgctgggggcaggggctccagataatcgggcagggatggcggccgaggcttcagagctggcggcagcccgggtccccaagcgcgatgaggtggggctgctcgctctgaagcagtccgggggcagcaggagtgtgcgggagggaggccgcgggcccgccctcacctgctcctgcccgggtggtccagcgacaggcagtagaggcccctccgggcgcacagcgcgtacagcaacctgcgcggcgccagcagctccaggtgccacacctggtcggggaaccggaacgccgcctgcggaccggggcgcgggtcaggccgacgcgacgcgcgggcccgcggtcttcattttcacgcgaaccgccgcccccgcccggtccctcccgcccccgcgggccggcgctcacggtcagcagcccgccctcctggtcgtacacgtagacgagctcgctcccggtggacaggaagacctctgcctcatggcacagcacgcggggcttgcccgccgccaggcccccgagagggcagcagaagcccgccaggtagcggacccgcggcgcggcgccggccatcgtgcgcgcgggcccgtcagagtgaaaagccccggccgcgcggcggcggctccgcctcggagcgctttacggcagcccgctgtgcggcgcgacctccgccgtaaagcggtcggcggtgccgggggcgggccggaaaggacgcgctgcagggactccgggagctggggcggtcgctggtacccacggggagcaggggagccttcctaggggccgcggcaccgtgccgcaggtcgaggttgacccggccgggctggtgggagccctcggcggcttcatggccccggctgctgcacgggttccccagggtggggaagcgggtcctggccgagcagaggttgctcttgggcggggcgtctccccggagcaagcgctcagctactcgggcttttgcgtaaacgcctcgattctctgggctctcggagagcagctgggtcctgccggagcgcactccagccggggtcggggtggggcagcgccggctcttgtcgtcctagggatgggtctctgccctgtgctctgcgagccgcccccggccgcccccgcgttcagggcccagcggagtgagccagcttaggtggaagtgcgtccctccctccgtggctgaacacgtggggacagggagtacaccaatggggtttctgggttgggggcagaggacaagaaaatgactgtgagccagggcaagatacctccaccctctccctcctggcagctctccacttcctccaggagagaagtactgaccagagaacgcccgtggaggggcctgcagtaccgacacctgctccatgcccggaagagagcggaaaccaggcacaccattcacaagtaaatgaccaaggaaccccgcccccggcccgcctccctccgtttaagaagccaatctgaagagcgctaaggccagacaccctcgagggagaatctaggggcagggctgcaaaactgggcttggaagttaggcagacatcgtggagtccgggtgcacctgctggagcacaaagcaccacttgcagacatcctgaccgcccccctttgaggttggggtggggactgaccccaaggcaacggggatgtctgattctgaatgttgggttagacagactcaagtgcggcacctggagtcagttccttgctcctctcttctcgccagggctgctctgaaggtgtttgggctggaaatgctgtctttgatgctggggagtggggagaggagggccaggtgcatctcatttggccttcagagtcaggaagtcagatgccgcatcgttgtgaatttccccacagggatcctccgctggtcttctgaccgaatttccccacaggaatccgcaggtcttctgactgctagttttaaccctctgaagccttgtgagtcactcgctcacacacaccaaccccatccagtcctcccaggccatctcttccatacggatggtaacatgccaagactgtcctagaggaaatgatcacgatcacgtggaggaggaaacggacgtgggagaaggcccgccaaaccagcagcctcaccccgcggtttactccgctgcccaccccactctgctccgggggctggcaggcttttggccccacgccaagcccagctcctatctgcaacaagatttatgatcagtagtcatgtgggggaccttaagcatggatcccaggggaaagggggtgagttagacacaagcgaagggctgaaggccggctctccatcagctgctgggctgtgccgtgccccacctgtacttggcgaagagtgatgagggctgaggcagcctctctgtccgtgggtgtggaagatgcacacactcctagcggaagctttcgagacagcagcgcagaccgctggacactgcgtttctatgcccaacttggaggtggtatcatctccctaagcacgaagtatatgacggagtcaatttaggtcagactgaggggagaaaaaccatgaagcttcaggctgtgttgagggcgaggagggctgggccttgagggacctctcctcagagcagcacagcccaataaggagaacacagcaggaaggtgaggcagggacccaggaacccgacttctccctttttttttttttgacacacacaggttctcactgtgtctcccaggctagagtgtagtggcacagtctcggctcactgcagcctcaacaccccaggctcaagccaacctcctgcctcagcctcccgaaaagctgggactataggtgcacactaccacgccaggctaattttttgtcttttttaatagagacagggtttcgccatgttggccacgttcgtctcgaaccccgggcctgagttctatttctaagcagtacaatttgcttgatttaatgggggagtggcatccagaactgttttaaattttttaattttggccaggcacggtggctcatgcctgtaatcccagcactttgggaggccgaggcgggcaggatcacaaggtcaggagatcgagaccatcctagctaacacagtgaaaccccgtctctactaaaaatacaaaaaaattagctgggcatggtggcggcgcctgtagtcccagctactcgggaggctgaggcaggaggatggtgtgaacccgggaggcgagcttgcagtgagccgagatcacgccactgcactccagcctggatgacagattaaaaaaaatttttttttaattttttgagacagtctttttttttttttgagatggagtctcactctgtcgcccaggctggatggagtgcagtggtgccatctcggctcactgcaagctctgcctcccaggtttacgccattctcctgcctcagcctcccgagtagctggtattacaggcacctgccaccatgcacggttaatttttttgtatttttagtagagacggggtttcattgtgttagccaggatggtctccatctcctgccctcttgatccgcctgcctcggccttccaaagtgctgggattacaggcatgagccaccacgcctggcctattttttgagacagagtcttacactgttcaggttggagtgcagtggcataaactcggctcactgcaacctctgcctcctaggttcaagcagttctcctaccttggcctcccaagtagctgggattacaggcgcacacacatcactacactggctaattttttctattttttagtggagattgggtttcaccatgttgaccaggctagtcttgaattcctgacctcaagtgatccaccagccttggcctccccaaagtggtgggattgtaggtgtgagctgccacacccagtttttttgttttttttgtttgagacagtcttgctctgttgcccaggctggagtgtgcagtggcacagtctcagctcactgcaacctctgcccccggggttcaagtgatcctccagcctgggcctcccaagtagctgagattacaagtgtgcaccaccaggcccatctagtttttgtatttttagtagagacagggtttcaccgggttggccagaacttctgacctcaggtgatccacctgcctcggcctcccagagtgctgggattacaggtgtgagccactgcgcccggcttttatctttacatcgaaccaaagaggatgccaaggatcttcactggctctcacataagacggccatgatcaggtactggctcactgcatggcccaggctgctgctttctctgatacaacctccccgagcctcctcacctcagctttttaaattttttttcagacagggtctcaccccgtggcccaggctggacttgcgatcacagctggctgcagcctcaacctcctgggctcaagcgatcccaggagctgtgggtaaatcgagtgaactgcactgtgttgaaggtgcaggattggagtccgggtgctgggggactcaccctctcgctcctggagtccagaagccaggacaccttggtcactgtcctgtggcctgcttcaccccagggccctccttcagaaattagttggagttttttttagtaactgctcaagtcagctatgagtcactgaccaaaggacaaagtggtgctgaacagtgactgccaggctcctatctgaggctcagagagcacttgttctagacgctttctgttgtcacagggaaagacagctcaagcaggaacacaggcagtgtgtcacccccaggcctcactccttgctgcacctgtgcagtctggccttcctgggctttgtccttcacctgctgtttgaccacatgtacctgtccacaaagcagtgactgtggggcagtcgcagggctgacaggtgcggcagaggcagaagaggcacccaagggcggcggggccgtcaaacactgacgcactctcctcctcccccagatgttagcactttaagaaacttatcgaggagccaaggttgggagggatcggctggggaagtgggatccccacctttaaatggaccatgcacatacacgtaaaacagtgatatcttggagacaagttatcaaatccccccacactgagcagatgccagacaacagttgagtgcgcaggaaggacacaccaggaccaggcagttgcttcaggcgcttttattaggttccactgcagggctggggtcaatgtaatgcaaatccaagcccagtgatgcacacctgtgagccgaaacagagccgaagcaggagcacctgtgtcccaggagcagctggttggagggagccagggccaggccccacctcctctcgggaccaggagactggcagccgctgtgttcacctgggcaggtgtgcacccagtcacccccactggattatggtgctggtagcatgagagggtgtgtccacaccaagggcaggtgaagatgcgaggtggggctgagacctccttcccacaagaggaggtggctgagcctcccagggcctgaactctcacagcagggctcacccccaagcctgtatgcttagctctgactctctttggacaataaaataaagtgcattactgaacaaagagtaactcaaaaccagaatcagacaaatcgccaatgcttttcctttagctaaaagacaaaagaaaacatgaatgatgtgaatgccggaacttcagagtaagggaaatgctggtggaggacaacggaaactataatagcgtggtggataaggacgagcgagtgggagaggaactggcaacgcggctctctctagaagtccgtgctgtccagcctctgcccagtggtgggggaaggccttggactcacagggaagcaatgcaggaagccttggccacctaggctcacagctcatctcaggaccagaggagacagcagaggacaaaacttcagtgtgacagctgctaggagggagagcagacagcccgcggtgggcaagctgggagttgcatccgcagcagtccgcttcaacccagctcctctccacccttcctgaccctccacaaaagctctgccgtgaccagacccaacccaactggcccctggtcccaagagcagatgagctgcttgggccttccacttggtgtcccatgccaggcggacctggaggtgtcagccatggccctgaccacttcagaagccaacaggcaaatgttctctgttcatagtgccaagaatgtgggtcacgtgggcttaccccccaggatggacacagaagtccctaagcagtctgcagctgggccagcctctcccgtgggtgcagagcagcccagatgtggccatcattaaggcaaagaagcatcgagatgcccaccactccccgggtaagagccaggccccggcctggccacgccacagaggaacgcagagcacacaagcaggaccccaccacgtgctgttccagatcgcccagtctccctctattggtacactatcaattgtgcagtgccccagggaggtcccaaatggccctcacaagaggcacagcccctaacgccctcagccaggcggtgcagtgggacgaagcagcgtattggggagggccagagcatcggcaccggtgacccagctctcccacccaggccatcgcagggcagcctcagggcaggcgccaccactgctcctgctcagcccgcagtatctgcagttgctgcagctgtgtggcttggtagaaaagtctcaggcactgaggtttacttcaagggagaactgactggtgcccccgtccacactcatcaccctggacacaacctcgggggcttcactaaaggagggaaggatgtggaaactagtctctctcactccccttttgtgcagtttttatcttaaaaaaaaataaataaaagtcttctgggcaggaattactgataactgttattataaccaatgcagactttaaaatcccacctggacatcgggtgagaggaggagggcaggcagcaaaccgacctgcagacctgcagaggggagccgtgtccagggccactgcgtccccaccagacaacagctactagaagaggaaagtggccctcacaggcagggtgcctgccaccaagcagtcagacaagggggtaaccaggagctcccagccagaaaaacatgggggcagggaggccaaacaaaaagcactgaaaataaagagaaggctgggtggtggcagcatcggcccctccctgtgcgccccaattccaggtgccacgtagaggcgagaggtctttccaacacggcgggggacttgtcaacaggattaggcgtgaggagccgctctgcgtttccagtctggagactgcattcagcctgcagaataccagccgtggcgcccgctctccagggaggaacgtgctgagaagcttcagtgggtcagggagcccaggacagccagccccttgttcctccagggctgcccactatggggcagttacagggaacacactcagcaacgcttctggcttcaggaagggctgggctgggcccggtcctagccagcagagggcaggcgccctaggtcctggggaggctgcacatctcgcagtggcctgtgcctggctggttcatgaacgtgcagtgctgacaggcccacatggctgcagtggccgtgtgtgtggagcccccgacggcgccgtactcatggagacctgggagctgcccgccaactgtgcctgcagggtggaagagaaatgagcactcatcatttctggcccaccagagactgccagagtgtgggcatgggggcaggggcaggcagctgagagctccccgcccccaacatcccacccagtgctggtcctgcccacacagcactcccaccacaggcacactttgaagtgcttaatgccctcagaaaaatgcctcctgcaccacagggagtaacagggagcctgtgcttgctggttcctttttgttgcagagggtgcttctccttgtgaataacgtaactccccgggggatgtgcatttgggttgtttccagctttttttttttttttttttttctgaggtagggtcttgctctgtcacccaggctggagtgcagtggcacgatctcggctcactgcaacctccacctcccgggttcaagcggttttcctgcctcagcctcccaagtagctgggattacaggcatgaaccacaatgcctggctaattttatctattttttggtagaactagggtttcaccatgttggccaggctggtctcgaactcctgacctcaggtgatccacccaccttggcctcccaaagtgctgggattataggtatgagccaccatgcccagcctccagttttgagctaatatgaacaaagttgccaggatcattcttctacaatttctttgtggacctgtgtttttatttctcttggataaaaacaaagagtgaggctgggtgcagtgggtcacgcctgtaatcccagcactttgggaggccgaggcgggtggatcacttgaagtcaggagtttgagaccagcctggccaacatggcgaaacccggtctctactaaaaataattagccaggcgtggtggtagacacctgccgttccggctactcaggaggctgaggaaggagaatcccatgaacccgggaggggaagcctgcagtgagccgagaccctgcctcttcactccagcctgggcgacacagcgagactccatctcaaaaacaaacaacaggccgggcgcggtggctcatgcctgtaatcccagcactttgggaggctgaggtgggcagatcacaaattcaagagatggagaccatcctggctaacatggtgaaaccccgtctctactaaaaatgcaaaaattacctgggggtggtggtgcgcacctgtaatcccagctactaggaaggctgaggaaggagaatggcgtgaacctgggaggcggaggttgcagtgaaccgaggttgcagtaagccgagatctcaaaacaaacaaacaaacaaacaacaacaacaaaaaacctacctaggaatgaatctgccggcccacagggtaatgaattgtgtgctgaactttctaagaccctgagacacagttctcgcgagggtggcacggttttgcctcccactcgcaaggtacgagagtcccagctgcttcacatcttcactcacacttgacattgtcgcgtttttttcatttcagccacactgatgaatgtgtaacggcttctcatgttttaatttgcatttccctgatgactaatgatagtgactgttcctgcatctccttttttttgttgttgccgaggctggagtgcaatggcgcaatctcggctcgctgcaacctctgcctcctgggttcaagcgattctcctacctcagcctcccaagtagctaggattacaggcacgtgccaccacacctggctaattttttttatttttagtagagatgggttttcaccatgttggcctggctgtctcgaactcctgacctcaaatgatccaccgcctcggcctcccaaagtgctgggattacaggcgtgagctaccatgcccgacctgcatttccttttgtgaaacgtttcaccctccgcccagcttcttcttctgctttctgtttgattaacaacaggcagagttatttttaagtttcagatagaagtcatgttgtgtgtatgtactgctaatactgcgtcccccattggtgccttttcatgtttctaacagtgccctgtgatgagcacaagtgttttgtttagataaatttatttatcaatttacctatttttatgccagtgtttttctgtgttctaccccaaggtcctgcatcctgcctaaaagaatctttgcgtaccccaaggccctgaagagattcaacttaataactgttttacagtttttatttttttaagacagggtattgctctgtcattcaggctggagtggtataatcatggctcactgtgacctcgacctcctgactcatgggatcctcccatttcagcctccccagaagctgggattataggcgtggaccactcaccatgcccagctaattcttttttttttaatattgtttttttgtacagacggggcttcactatgctgtgtgggctggtctcacacttctgggctacagtgtcctccagctttggcctcctagagtgttaggattatagctatgagacatcatgcccagcctgcttcatagttttaccttttaccattaggcctatgacccatcctgagctgatctttgtgtcttgtgtatacacgtctgtaatcccagcactttgggagaccgaggcaggtggatcacctgaggtcaggagttccagaccagcctgaccaacatggtgaaaccccatctctactaaaaatataaaaattagccaggcgtgggtgcacgcctgtagtcccagctactcgggaggctgaggcaggagtatcacttgaacccaggacgtggaggttgcagtaagtggagatcatgagattgcactgcagcctgggtgacagggtgagattccgtctcaaaacaaaacaaaacaacccatgagggccgggcgcggtggctcacacctataatcccagcactttgggaagccgaggtgggtggatcacttgaggtcaggagtttgagaccagcctggccaacatggagaaaccctgtctctactaaaactaaaaaaattagctgggtgtggtggcagccacctgtaattccagctacttaggaggcagaggctggacaatggcttgaacccgggaggtggaggctgcagtgagctgagatcacactactgcactccagcctgggcaacagaacaagactttgtctcaaaacaaacaaacaaaaaacccatgaaaaaatgcccaacatcactaatcatcagagatgcaaattaaaaccacagtgagataccagtcagaacttacaccagtcagaactgcctattattaaagagttggctggacatggtggcttaccactgcaatctcagcactgaggcgggaggatcgcttgggcccaagagttcaagaccagcctgggcaacatagtgagacctcatctctacaacaaatttaaaaaatcagccagggatggtggcacatgcttgtagtcccagctgctcaggaggctgaggcgggaggattgtttgagcctggggaggtcaaggtgagactgacctcaaatgccactgcacttcagcctgggtgacagagtgagaacctgtctcaaaaaaaaaaggaggggggaaaaaaaaaaggtcaggtgcagtggctcacagctgtaatctcagcactttgggaaccaaggcaggaagatcacttgagcctaggagtttgagaccagcctgggcaacatggcaagaccacatcttttttttttttttgagacagagtcttgctctgtcgcccaggctggagtacagtggcacgatctcagctcactacaacctacgcttcctgggtcaagtgattctcctgcctcagcctcctgagtagctgggattacaggcgctcgccaccatgcccagctaatttttgtagttttaacagaaatggggtttcaccatgttggccaggatggtctcaatcccttgacgttgtgatccacctgcctcagcctcccaaagtgctgggattacaggtgtgagccagccaccgggcccggccaaccctatctcttaaagaaaaaaaaaaaacaccaaccaaaaacattagttgggtgtagtggctcatgtttatactcctaggtactccgaaagctgatgcaggaggatcgcttgagctcaggaattgaaggctgtagtgagctatgatcactccactgcactccagcctaggcaacagagtgaaaccctgtctctaaaagggaaacaaaaaagaaaaaaaaaaaaaagactggtgtcattgttagaactgcatcaaagggctgggtgcagtggctcccaggtataatctcaggactttgtgaggctgaggtgcaaggaatgcttgaggccaaagtttgagaccagtctgggcaacacagtgagacctcattgatacaaaaatattaaaaaattttgcagccataaaaaggaatgaaatcatgtcctttgcagcaacatggatgcagttgaaggccattattctaagcaaactaatgcaggaacagcaaaccaaatactacatgttttcatttataagtgggagctaaacatgggtactcacgtacataaagatggcaacgccaggtgtggtggtacacatctgtaatcccagctactcgggaggctgagggaggggaattgcttcaacccaggaggcagagtttgcagtgagctaagattgcgccactgcactccagcctgggagacagggtgaggctccagctcaaaacacacacacacacacacacacacacacacacaaagagcagggcgggctgaaaaactattaggtactatgtgtagtacctgggtgatgtgatcaatcataccccaacctcagcatcaggcaatatacccaggtgacaaacctgcacatgtaccctgtgaatctaaaataagttaaaattatttttaaaaaacaaacaaataaaaagcaacaacaaagccccaagaattagctgggtgtggtgttgcaagcctgtggtcccagttactcagcaggctgaagcagaaagatcacttgagcctggagtttgaggctgcagtgagttacgattgtgcaactgcactccagcctcggcaatagagtgagaccctgtctctacaaaaataaaaataataaacaaagaattgtgtgaaaagaaaacctcggctgggcgtggtggctcacacctgtaatcccaacactctgggaggcagaggcaagcagatcacaaggtcaggagttcgagaccagcctggctaacatggtgaaaccctggctctactaagaatacaaaaattatccaggcatggtggcacatgcctgtagtcccagctactcaggaggctgaggcaggagaatcgtttgaacccaggaggtggaggttgcagtgaggcaagatcacgccaccacactccagcctgggtgacaagagccaaactccgtctcaaaaaaaaaaaaaaaaacaggaaatggtataaaggtgtttgatgtgtcttttgaaggctgtgttaacagaaggattctagcatttgtccagggccgtagctcccgggcactctggtgctctcagctgcagggactcagggcactcgggctgcacgaggcaccacggtgcgtgaggagtccctgcagcaatgctgacagaaggttctcacgagtggggaatcgttcaggacctggtgactgagggtccggaagacacgcaatgcctgcggtccgttccgtagtgtccaccagcaacaacatggatgctgcaggcttctcctccttacagctttaagcactaaagggaaattctcaaggagaccaaaaggtcccacgcttccggcgcttccataaagtttctgattctcttaagacaatgatgttcaaagtgctcctaggatgcctggagattagtatctctgatgtacaggtttataaaatttacagggctgtgtacctaagacgtacggcctggacaacatgtctgctccatcaccggagcctgccacgtgcctggcagggaggccgagtctctactcgttgcattgccgatggcacctgccaggatgcagctgggtgcggaatccagggcaccaccggcagtggggagctgtgcagagtgggctgctctccggccccagccacggggtgccggggcagggggtgggggtactcactgcacagctgctcgatggtggcccactgctcagacctcttccatgtctgggcgagctcctcatttctggtccgcacggcctccagcagcaagctgatgctgtcctacaagaagccaaaaggaaggttcctcttcgctgtgcctaaggtgagcagcttcctgctagaacaggtttctttctccccaacatcaagacgtatttctgaggacattttaaaaatcttacaggctatcactataaaatgcaaactgccacaacttacatctataaacgcaagtgctaaattgaactagaatttaaattcttcccaaataggcccaagcgggcatctgtgcctctgccttgtgctgacggtgctcaacagcccggaggataggagctcatgcctctcgtcctggaggctgggatggagggcggaagtcttgactgtgagacgtgtcctcctccctcacatttcatccctctgcctctttctcctctcgtgtctggaaaaatgcactctctatcctagccttccgagtcaaactgcaggggattaatgcattaaggatgggcgcagtggctcacgcctgtaatcccaacactttcagaggcagaggcagacagatcacgaggtcaggagtttgagaccagcctggcaaacgtggcgaaaccccgtctctactaaaaatacaacaattagacaggcgtggttgcgggcacctgtaatcccagctactcgggaggctgaggcgggagaatcgcttgaacccagaaggcggaggttgcagtaagccaagattgcgccaatgcactccggtctgggcaacagagcgagactccgtcttaaaaaaaaataattcatatatgagaaacggataaagccttcaggagctctcagtacctccagagaatgtcttccaacagatgactgcaaaaatagtgcagtatactagcaaggtggctctggtgtagagggagcctcacctttcaccacctgtccagacagatgggcagcagctgaacctcggagcaggaggtgcagttccctgggctgactagggaaggcacaggcagggaagaggcacagggtgcctgatgtcaaatacccgagtgagtggttttgagacaaaatacagacacaaaataaactagcaggatacaagaacagctataggcttcctgacagagaaaggccgggggaggaggagcctctctattctgtctccttcagggaaaagttctgagtcagtggcggagcagctcagaaagaatttgctcctttctctttggcatttcctgttggcttgaacagtgaagaaaaagccaaagtcggacccctacacacggcaagaacctcctgggggctgctgcccactggcccccactacccagagcagccacttctgcaaagcactcgccctcttctcccccaacggtgtctcttaaaaatgccaactgtgcagctgtgagcttggggtctggaagctggccaagccttctgggccaaggcaataaaaccagagttgatttaggaggaggggagatatgagtaaaaagcagaggctgtgactctgaaactgttagaacaggaattttttaaactgtctaactctaatgctggaggcagagctaaatcacctctgcttcccattcgattgtaacagatgaaaccgtacttcctcacagaggtgcagacactcaatggaaatgctaaaggtgaaaaaattaatctatcaacaagcttcttgtgaaaagctgctgcctacactctgcccataggacaaatgagggggacaacctgtgaccccgagctttgacccagtttcccaatcatgctctggtctgggaggaaagaaagcaagacacaggcgtctctttgcagccaaagcccacttgctcaagtggacaccacacttggacacgcacctgcagaggcataacttcattggtgaccaggaacagcaagaggtggaaatctgagatggtatccaagaacacagatgaggtattctgagacaaataggtggccaagctatggaagtcctagaggaatgggaataaacatgaatgttccatacagttccccagtgccagaccccgaaacagagctgtttcctactaagacgcaactcaatacactgaatgctgagacacctctccctctgcctctgcaaccacgaacagggtccaagaaagaggagcaggcagctgcaaagcaagctcttgctctcttctcccaagaagatgctctcagcacacctgactacccagatgtgcaaggagacatgcttataaagctgactcagactggccaggtgtggaggctaacacagtaattccagcactttttaggaggccgaggcaggcaggtggtcaggagttcgagaccagtctggccaacatggcgaaaccccgtctctactaaaaatacaaaaaaaattacccaggcttggtggcgcgcacctataatcccagctactcaggaggctgaagcagaagaatcgcttgaacccaggaggtggaggttgtagtgagccaagatcgcaccactgcactccagcctgggtgatagagtgagactctgtcttccaaaaaaaaaaaaaaaaaaaaaaaaggctgactcagacagagacacaaacatggaaatgcgccctggtcccccggtggagagtgggctgcgggaggggcctggggcccccttcacggcagggagacaggtctgacttttcctgtcgagctgtattctccatctagggcagcaagagggaggaatgtgcagggcagccgtgatgcagcacggacatcttcagcagaaccaaacacagagcttcaagagtgcaccccaataactggctttgcacctctgtgagcaccccaagtcccctgggcggatgggcactgaggggatcaaagcatagaagaagctttgtcagccactgaagaaaacctcattatagacattctttgaccaccttctgaaatgtctgttagcaagttatgatttaagaacaaccatgtgtacacagcctgtctacacagtatgcaggcgtgacagcaaatcggacctggcctgatctgccagtgagagcagaggccaacacgggagccacgctaagcagcagatcaacactacacacgggaaagccgaggccaggccgagaggggccacacagccccaaggtgcctaagaagggcagcaggtgaccaggcaggggccaggccaaaccaacagtgacgaggctgctggcagaagacacaaagcaacacatttgggaaaattacgaggtccactgaagatgtggccagtcaggacgtcaggggattagcctttgtggccgtccatcacctagccatgggaagggcgtccacgtgaccagcagtgccccacagtaggccctagctggcctgtcacaagaatgaatcgggagcatttgaaagcttgatgttttctggaaaaacaatactgacactagataacaatcagcagttaccttaaattatgtttctaaagacaaagagctcacctgtgtctcacccaatacatcccggttttcaataggaaatggattttgcgaaatagaaaaagtgtaaactggatccttggggaaagttgttgtgatctaatgaagaaaaacacaaacccatgataaatgaggctgaaaatggtgtggccgactcccagccagcccagagcatctcccagagcccaaattaacgactcctagcaattctgagaatgttctacaagctctccatcaaagggaaccgttatctattagtgtcatctctaaacgaacacttggaaactccgccatcctggagacaaactacaccatatccgggcagcctccggcctgtgcaccggcctcgacgtcggacaaaaagggcactgggactcccctcgtggcacagcttcccttcagagtcacacaggttctctccctctgctatggaggaacgaaaggctggtttggccccttggccaggtgacaggaaaggaacggaagggccaggaggccgccccaggagctgactttgctcaagagagattcgtgtcattggattcggagggcaaatgagcaatcagccagctttcaagacacaaagcacccttcagcagctcactaagccccttctgaatgctgggagccactccacggagctgtgggcttttccaggcaggggtgaatgtaaggcccttgaggaacacagggttcagctcttctctctccctcagagctgatacccaaaggccagctaagtccttcagtccttcactggctcagacaggccttaatgacaacagagggcactttgcacctaagatataatcaatagatgctacagggacagtggtaaatgtgcaagaatcaatagaaataccacttttattcttcgtgacagacacccctccccaaagcagcaccgagttgagttgatgctgcttttctctgcaacacaacagcagcagcagaggtcacacctcttccagatttaggggaactattctggttcctttgggactatttctaaagaatgagtgtggttctggtctgttttctgcatcagcaaaggcagtgagttgttgagctagctggcccaggatttgctgtgccagcgccagccgctgtggaaggacagctgagccaccagcagcatctctggcctgagctggcccttcatgggcaagcggcggggtgggtcatgaagactcgggccgcggtgccacgtgtcggctacatggcctcgtcagttagggatcctgggcctcactttactcttcctcaggatgaagatgatcggagtactcgcctcctgggtgcccagcacggggctggtacacatagtgttggtacacacagtgctgggtcccagctgaagacaggggaggtgctgacctcctgcagagacaaaagcctggcctgctcaggcgcgtcccttgggaaggcctagaaatgaagaaggcggcacccccagaacacgtgctagtgagtgagctagtgggactgacgggggctcttgctggccttgtaactggcccttggaggggaacagaaccaaagtccacacagcccatcccagatgtcccaaggaagggcatcagctcccatcttacactgaagccatttccctaccctacccatcgtctatcagccagatgatgcccccagaacccacaaagaaaccccagtaacactggctggtgccttttcctgcctgcccagccatcccatcccaaggtttaagaaccttggctgaggccagcgcctgtggcccagggctgggcatggagcttgacacacctctctgggcacctgctctcaaggactccccatgcctcacttccacagggtcaaggagcctgggcatcacagagcagaatgctctcccacaaacaagtacttctgaaaaactgcactaaggcaaaaacttaacttcctttataaaagaagaggaaagaagtggggaggctgcttggggtagaagacctgagaaagctggttttaaatcatgcctgctcctcctgggtgcatgctccatcaatctgttttcatcttaattacaccctaggtagtctaaaaaccagatgccttcacggcctaggtaataaatatgttctcgggagctgtcagttggaatggtgcatcgatgggcttggctcgtggggacctgctgttccgaatgcaatgatattttactgcctgaatcacgtgcccatccaatttcaaatgcagcctgaatagatcctggcgtggcagcagcataggaaatgagccgcctcccgtccgctttggacagagctccggtggggctgatgcactggcttctgcaaaggctcatcctgccatccttgctgccctgtggccaatggtacagccatgtctccatgaccataaaatgcctccaaaaaggagctgagacacagggaagatgtggaagagccaggggcctttgtggctcctggagttccacccagtaaaccacgctgagccctcactcaagaacactgagttacaggtgtgtcccctggggaccaccctggacggagtgacccagacacactgtgggctgtggcagctgtgctggggctagggcaagcacctgcacgtgcaggacagctgacagccacacaccaagcacagcacatctggacaagactgcttgatgctccggtgactggagacccaagcaatgggggttcgctgccttccagaggctgcctagcctggggtcagtggtcctttgtactttagtatggggacagttaacccctaggttgacgtcaaggaaataaaaacctgagactaaaacaaaaagcccttaaaactgtgagcatttcagcaacaccgcatgctcagtgattctacaaccacctcctgggtgcctgttctggggtgggcactgctcaaggcagagggtgccttaaattgcagcctcctcccttgagcagccaccacccagcagtcccacctacaaggcgcccaatgggtccacctgcccaagctgtgcatggggggcacttacgtctatgatgagatactccacaggcaggggccgggccagctgggtgatctcgttgccaaacttgtctacgtcctgcaatagtcagaggggaacagcggtgagcaaagacgatcagtagtaatgattttcctttcacatgcttgtctcaccttttatttaattaatttatttatttatttatttattttttgagacagagtcttgtgctgtcgcccaggctggaatgcagtggcgtgatctccactcactgcaagctccgcctcccaggttcacaccattctcctgcctcagcctcccaagtagctgggactacaggcgcccgccaccacgcccggctaattttttttgtattttttagtagagacagggtttcactgtgtttgccaggatggtctcgatctcctgacctcgtgatccacccgcctcagccccccaaagtgctgggattacaggcgtgagccaccgcgtccggccttcactttttaaattacttcaaatcttattgaagtgtatggatagcagaaaggaaaacgtgcatatttttgcagtaaaaccaccttccaccatttcttggagctcattataaccacagcctgaaaaagcagtcgtgctctcgggcactgggactccccactgggagagcacatcaaatgcctcctctccacccatggcgcttggcctggcactcaggcgcgatctgcgacaggcagaagggtctgcgttcccctcaggttggacctgtgccctgtctatcctccaaaagcacatgaatcctcacagtctgaatgctaactcttagaatcttactcacacctctgaaaacccgactttccagaaaccgagtacttggacattaataaaataaaggcatgcacaaatgagcgcacacacaaatatgaagacacgggaaccccacaccaatctgtcaaagtctcaacttgttttgctttgtcagatgcacagaacataaagtttaattatggggaaaaacggccagcatatgttcattaatcataaaatgacaattagatctgatttatgtcaaacatgctgagttcaaacagagctccagaaataaattcataagaaccaaagcttttcattaaagattctgcaagaggggatcacattttctatctaaatcatcacttaacattatataaatcattcattaagtcatatataaattatacatccataatttccaattatagggccttacataaaagtttacgtttattggagctctcagacccgaaatgattgccaagcaaatctccctgaggtgtgcagggtgacaggaggccacccccatcacaaccacaccttcctggggatgtcaggaagccccgctgtcttctgagacaatcatcacaagctgttcccaagtcaaaccaagtccattaccctaatgagaagccccaggcccccatttggcccttggccctgtttcttgcttgaaaattaaattctggctggtccgaaggtggtgagttacctcagatgattgttaacagtcagttacagatccaactccttgttctactctctcccctttcctcactattgtacttgactagtcttaaaaaataataaaaaatttttaaattcaatttctggcctgaaatgtgtctcagttctccataccctcacaccttttctctactcacagctagagagctgccaacaagaacttgcctctaccctcccagagaaaaatggtccaaatagatcccactgatgtttccaggagggcaggagaatgaacctggactctatttccatttcacgtattgctccccgccccatcaaaggctacattcctgcaaatacacagctctgctctgtttgccttccttggacactgaaatgactttccaccgacttgggtgagggtcgtgtgtcctccttccacgtgacgagtggctgccagtcaggatgggcttccgcattctgcgctctgctggctgtgatgggggcgctaaagacacagggcctactgcacggggtcctggggccccaaaagaggtggtttctcaatggagatttggtaggaggcaaaaatcaaatccagtcaaactaaatcaccatttccaaaaatacaggcttgcccctacaagaaataaacctgcaacaactcacacataattagcccatctggaattcatcttcaaatctaattaagctctaatatgcagaaacatttttccagcacctgttcactttaatctccccctctagggatttttcttgttaaatgcccctctctcttttttgtgtcatgctattctctttcaaacttaactacccaactgcatcttttccactccccaagaaaataaaggtgttgtatccccctttcctccctggggaaacaggtcacttctacctctcccccaagccttcactcagatgttttcgccagccaatccctaggcctacacaccattttaaaaggcaattactttttatgggccttagaaaatgtcagttggaatgcgctgggaggaggttgtcttaattctaagtttggcagccgtcaaagtgtcagcagctttatctccacctggagcgaggcaccaggaggtcggaggttgtggccccaacacctcgccacccgccagaggccacttctggaagcagtggcgccaaggtcttgacaccaagagaaatccagggatcgatgtctttgttagctcaaaagcaatggggatgcccagggcacagtggctcatgcctgtaatcccagcgctttgggaggccgaggtgggcagacggcttgaggtcgggagtttgagaccagactggacaacgtggtgaaactccgtctctacaagactgtctccaaacaaacaaacaaacacacacacacacacacacacacaaacacaaaagcatgtgggctttatgccaggacaacagtgaattccattgattgaatggcatcaaccctgctttagaaaaggtaaatgaaatcctgaatgtgctgcttttctaagaactggcaagaaggggcacaaatgacaccaggatctgagccgccacaggataactcagaaaaaacaaagctttcagacactcggttacttttctttttttttgagagggagtctcgctctgtcgcccaggctggagtgcagtggcgcggtctcggctcactgcaagctccgcctcccgggttcaagccattctcctgcctcagcctcccgagtagctgggactacaggtgcccgccaccacgcccggctaatttttttctattttttagtagagacggggtttcaccgtgttagccaggatggtctcgatctcctgacctcatgatccacccgccttggcctcccaaagtgctgggactacaggcgtgagccacagcgcccagctgacacttggtttcttaaaagcaccacttagaaaatagtccagtccgtgtgcaacgactggatgcacacagaactggcagctggcatttctcaggggccagctgtgtgcacagagccacttcgtcctcacaaacacactggtcacaggcactactgctgtccaagacaggaagggttacaaagatgagtgaacctcctaaagcaatcggcaaggacagctggacagctgtgtagagactgggccccccacactacgtgcgcaggctccccgcctcccaagtcagtgccggtgctgcagggccagggcacacgcaggcctccctcctgcctttggggaaccttgaagttgaggctcggaccccaacagccgtctcacactgagtaagactctcccacctccaccgcaagggaagatgcaaaattttctcttaagactgggaatatgctataataagtgattcagaatctcttctgtcgatggcagtttcttgattaattgataaacctgcctgaataatgctggaagcaaacacaatctcctatgagtgaaaaggcttgttttaaaaagttgcgtgctgctgggtcttgtgccagcaaatacaagtgggttacagggctatagcaaacagagcagtttggtaacaacaaaggaatagattgtaggtaagtggcacagaggacgatgaccagaagtaagacatgaggagacacagataccttgttttacaatgaacagtgggactaggtcaaccaggcaaacatctagagaagcacaaaagctagattcctacctgtaccagtatcatgcataaatggattatggatctcaaaataaaattaaatcctaaaagcacggaaagagtatgtaggtagatgcatagttctgggggaaagaattacagttggccgttgcacaacgcgggtttgaactgagcaggtccacctataggcagacttttttcaaccaaacacagattgaaaatacagtattcgagggctaggaaactcatgtatacggaggtctaactttacatataagcaggttggaaggatccactttggggcgtgagtgcatgtggacttgactatatatggaggtcctggaaccaatcctctgtgtcaactgaggggcaattgtacttccaaagtacgatgacaaaggcagaaattacaagaaaaagagttaaggtatctttgaaatcagaaaatatttcagcttctttgtataaaagacaaagaacgaaaacctggcgtgtgtttgcaacacacgacaaagggttaatatacaaagacctcacaaatgaatgccaaaaatgatgaatcactttacaaatacttaagtgcacacagaggctactcacaaagaaaacagtcagtaaacacaggagactccctgtggtcaaagaagcacagagagcggggtcctgggcctgcctggtccttgccagagtcacgggcgcgagggcaaggctggtctgcagcaccacctgcaagtgtccaccctgccacattcccagaggaaacgtgggaggacacacagacccttcgagtacatagtaagcttcggcaacataatcctagttctagcaattcatcccaagtaatttaaagcatgcactaagaatgagttacagggtccaccaagtgctgttcacagtgccagatgccaacaaaccccacggcctgctgagtaagcaatgcctggccacagcaaggggcagtgggttcctcagagataccctctggcccctccacagctggctccttgaaggaacgctgttcccttgctgctcctatgtcccctcagctccccacggcgctctgacccgccccaccccatcactgtgtagtcctcgccagactgcctgtccgcacagctctccagacagaggaccccagcactgtcccttggcaccaggacatcaccctcccacctctcccagacccttctccttgacctctttagagcagccatccttggagttgctcaacgccctcttctcttctccctctgaaccacagcttggctcatctacttccgggttagctcaacgccctcttcttttctccctctgaaccacagcttggctcatctacttccgggttagctcaacgcactcttctcttctccctctgaaccacggcttggctcatctacttctgggttaatttaggctttctccacagatagtctgaaaagggaactattggcctgtatctcttgcctgagcttccagacctgagtcctggcaaccgtctgtcctgctccatcttcaaactctgcgtgctggcacctggactcaccatcctcccacacagacccatggctctactctggcaccagtgccaaccctgctccccaaaaccaggaacctggcttgagcctgtgctcctctctgcacacctgccaggcctccaaacctctcagtcccagcacaccatccttgtccccaaggccacagggaactgacatgtggcctggattgccaacaccaccagcttctcactgggctccccaactccaaaccgttccccacactgcagcccaggatgggtcttctacagcggggacctcccctgcccaccccatccggctgtcagcacctgtccactgcctctcctacctggatttcagccccactcactcctctaaacttgctgccttctcctgactcaggctactggcatccaatgcctggattgttgcaaaagcttcccgcctccagaccacccctcctgacacctccagcaggaacattccagaactcactttccataagtctttccatggcctcccactgtccaccacaagccactccagctagactggccccgccgggtgcatgctgtgctctccaggtacatagcttcagcagattccactccgcgtggcttcctctcacacactctagtctcagcactgtgaatggccacctcggcgcaccctgctccccaacaggacacctccacagtttccaagaagagggaccatgagggacctgctcaccgtggcgccccaggcctaacacctgacccacgggaagctctcaacagataaacggtacgactggtccgttttctcactgctataatgaactgcccaagactgggtaatttataagaggtttaattgactcacagttcagcatggctggggagccctcaggaaacttacaagcatgacaggaggggaaggggaagcaaggcaccttcttcacaaggtggcaggaaagagaagtgccgagcaaagggggaagagccccttataaatctaacacatcttgtgagaatgcactcactatcactgagaacaggatgggggaaccacccccatgattcaattatctccacctcatctctccttgacacctggggattgtgagtcaagatgaggtgtgggtgtggacacaaagcctatccatatcacaaagggtgctagggggcgtccattttcttcttaccaatctacaatatttaattttttcataataaacatacatttcatttcatatttaaaatgttccatatttatttatttagagacagggtctcactatgttgcccaggcaggagtgtagtggtgcaatcaaagctcactgcagcctcgaactcctgggctcaagcgatcctcctgcctcagcctactgagtacctggggccacaggtgcacacagcatagactgcatgcattactgtttagcgtggtggctcacgcctgtagttctagcactttgggaggcaaggcaggtggattacttaaggtcaagagtttgagaccagcctggccaacatggcaaaacccctctctactaaaaatacaaaaaagaaattagctgggcgtggtggtgggcgcctgtaatcccaagtacctgggaagctgtggcaggagaactgcttgaaccagggaggcggagattgcagtgagccaagatcgtgccattgcacatcaccctaggtgacagagcgagactccatctcaaaaataaatagacttcgagctgtctgatgcatgtggatctttagatttgagaccctcctgctgccagcctctccctcctacctggacaacacccccttcacaagttcctggtctaaaaggtggtctccactccagcctcccccttcagctgaccctgtggcttcctgtgagcaagctgatccccaaacctgcatcccatcgctcctgccagctccacccacctctgcctcccatcctcattgtactgacctgtctccagatgccccaaagctgtccctgacacacggaccatgccccttcctctctgtgtgccaattagctcctttgctggacaccaggaagcagtacatgcccatgtcagtatttcccttacgttaataaaaacccaaacaagaaaacttctcaatcccacttcccatactggtgactgtcctttgctctccctggcagtgaaaccccccgaaagagtcatgcagcttgctgatgtgagctcaccccccattctcctctgtgagctcaccccccattctcctctgtgagctcactctcggcagccgcttatctactactcagccaggctcatcaaagctcccaacacccctgagctgctgaaggcaaagcctcctctcctgactcaccagggagctcctttcttgcctgccttccagggcgctatgctcctgcccctcctccccagctcctgcctcccagtgctctccacctcattcccccaaggtggggttctcctcagccatcccctccaggatggacaactcggcctctcaccaggcctcaagcaccaccccaacaccatctgtaccatgtgcctctcccaagcaatgcgctcaccccgggtggtgcctctgcactagcacatcgccgacagatccccagccttccagcctggcctggacaccctggagtctgcctgcctcttctctcgatcacaccacacactcaaccccctcactactgcacagccatctctactctctaccctagtctccttttccagctccgagcccagcagccagagtgatcgtctcacagccccggcacagccatctcccttcagcacctttcagaagccctcatctcacttccaaccatagattcagcttccaagggcccctcccacctctaccccagcaggccaccctgcttatcactctctgtgtggggaacaggctgctgcctctgtctgaacaatctcctccagacacccccagagctgctctgccaattgacaccttctctcccctctcaggactcgacccaccagggcactccaagcttctctacccgttccgctggggtggcccacctcccctgctgcagcagtctccccgatgcagggagcccttctccattctccatgaactccagggcctggcaattcacaggtgttctctaaacatgagagaatggatgccgtgagagcatcgcacagtgaatcaggtcagtgctaccaagggcttggccacccaaacacaacagctctcgctccccgctcagctctgaagggcccagggccagcctcccatgcccacagctgggggcctgggagagacatggcatggaagtacaaaatccccagtggccctgggccagcccacccgtgggcttatgcccgtcagactatttcctcatggctgaaggagaagaaaatagagattttaaaacacagtaaggctggaagcggtggctcacaccttaatcccagcactctgggaggccaaggcgggtggatgacctgaggtcaggagtttgagaccagcctggccaacatggcgaaaccctgtcgctactaaaaatacaaaaaaattagccaggcatggtggcaggtgcctgtaatcccagctacttgggaggctgaggcaggattgcttgaacctgggaggcggaggttgtagtgagccgagattgggccactgcattccagcctgggcaacacagccagactccaacgcaaaaaaaaaaaaaaaaaaaaaaaaaaaagttaataaaatcaccatgtcacaaaagaactgaaagccagccccttgtcaaagtgcccaattgttacttgtcctcaagaggctccctcaaacccaatcaaccaattctccctgccccagaggaataagccctgtggacgcccagacccttggcataggtgcgagcagtgaggagacaactggctccagccagaggggcagccagtcctccacagcaccaaggccacctctcctcactcccccacaacgattacagaaatcagccagtgaaggcagtccatgggaagagagtatactcccggggcgccagccagcaaggtggtaaaggcacagctacaaagccaagtcagattccagacactagagccactgtcccatgtccagaggagtgggaataaaaggactggaggctgtgtgatctctgtggcagaagggtcgtagcctgccacatcctcacacatcacacagacgcaggaaagagcatcccgaaagcagaggcgcaggaataacttagaccttctgggcagagctagtagcctcgctatgccctggatggagtcccagaccatctcaaaatgtctctgggacgtgctgacagcagagacatgcttccatggtggacccaccacaccctagtgtcagagagggaacatgaggagggctcctctgtaccaaagaacacccgaggggcccagacaccacagtgaatcaccagaaaacatggagcatagacagagccagtcggaagacttacttggggaacatttccagagaacttatgattctaggagcccaagctgaggcccagcggttgtcctgcaggctgcagcagcacaaccaggagggccgtgaggtaagcgagctgtggcatgacgggcatgaaagggcaaagctgaagatgcctgcacgtcacatccgtaccaggaggttttcagctatgatgcccgatgaggggcatggacccgagtttcaccttcagtgggaagcagctgaacacctaagcatctagcggtgttctgtgtgtgtatgtatgtctgcatgtttttggaggagtcttgttctgtcgcccaggctggagtacagtggtacaatcatagctcactgcagccgtgaactcctgggctaaagagatccttctgactcagcctcctgagtagctgggaccacaggctcatgacacagcacccgactaatttttttttgttgttgtagaaatgaggtcttgctatgtcacacagactggcctcgacttcctgagctcaagcaattctcccaccttggccttccaaagtgctgggattacaagtgtgagccaccacacctagtctattagtattctttttaaaggaaaagacagaagacagtcaagcgcctcctggctgtacaacagtctacgagtgtgagtcttgtccctgtgtgatgggcaggaggtcccagcctgcccaaacaaaacccccaccagctgggctctggggctgcacataaagctccacagctgcaggctcttggggctgatgggcagtgagccacagccagcctcccgattcgaagaaacacacaaaaacccaaggagcctcccggccagggccaggcctcctccctgcggcgccgcccctgcgcactcacaactgagcgcccatgtgcgccagcacagcagccactgccacgtgacgcagagtgtgtgtgacacacccatgtgcattcatggctggaaagttattttaaactcttcttcctaattatcaagagagatgttagtgtgacttttcagtgagcgacttggaaatatctatcaaaactcgaaaaaccttcctccccagcaattctattttgaagatatacaaagatgtcacaggaggatgtatagggtgttaaatgtggcactttctgtaacaaccaggaagaaccaaaggccatcaacacaagaccaattaaatacattctgatttggccatatagtcaataaatgcactcatttattctccataattacaagtctttgttttgaagttaaaagaatagaaaaggaaacaagaactctaccagatgcaaagagtagttatcattaaatatgttttcttcatgtttttctgcaggggacaaatgttccctttcacaagaaaggtgaaagagaaaagccccacgtcctgccacctggctgccccagagatgagtgaggctggctggccctagtccctcgggaagctcctggtcctcacaggactatgtgtacacccatatgctttcctaaaaaactacacgtgaacgatgacacaaatgtgccttcaaatcacttctccaaggccagcatctgcacagctcccctcatctgtccacaaggctcttcctcgttctcttactggctgcatatgggacagggcaaagctgtagactctcctccctcctgaaggacagtcaggaagcttctactcccaccccatgtgtgagtgcatgtaaatgtatgtccacatccatgtgcaaatgcctatacgtgtcttcaagaaaataacaaaaaaaattggtattatactctaggtatagatgcacttttaattttgctttctaagttttaccccttatctttaaataatttgcaaacacatacctttagtaaccacatgctatcccagagtccagctgtaacttaatatgcccttgggacagggcttttcaattgtttcccatttttattgccagagacaacaacatgataaacagcagcctcagacaaatattggtgcaggttttgtttacaaggcatgtcacctccaaccgcaaagtccatgggaggactaaaaggatgacttcaatgtttgcttttacagttctctttgctccaactgatattttcctgaaacatgagaaatctgtctcaaatcctacagggctataaacaattctgggaagtatttctagcctattctcgctaacagagggcaaataagcactctatgaaaacaacagaatgattaaggaaatgtcacatatttcatgacaaaagggagctccattcctaagtgcaagaaacttacaataacgcatggaaataaaaaagccaatttccaatctgaaaagggtatttaaaaataatcctacagcaaactcacagttaatgataaaatcctaaaagcacttgctttacaattaaaagcaagacaaaggtgccagagacttccactgtcatgagtgctgtttgggagatcccaggcaacactgggaaaagcccagagaatgagaagggctgatgatggaaaggataatacgtgtaggaaatgcgaaagactaaacttataaataataatactgaggaacagatagcagttgctggatacaaaaatttacctgtttcaaacaccaacagtttaaaaatgtaattttaagatagtgctattttgtaacaggcttaaaaaaaattaaagtacctaggaataacctaacaaatgataggtaagacctccacagagaaaactgaaaacctttctaagagacattaaagaacatgggaacgaggcccagcacggtggctcacgcctataatcctagcactttgggaggccgaggtgggcagattgcctgctgagctcaggagttcatgaccagcctgggcaacatggtgaaaccctgtctctactaaaatacaaaaaatcagccaggcgtggcagcgtgcgcctgtagtcctggctactcgggaggctgaggcagaagaattgcttgaacccgggaggcggaggttgcagtgatctgagatcgcaccactacactccagcctgggcgacagaacgagactctgtcgccaaaaaaaaaaaaaaaaaaaaaaaaagagtatggtattagttctggtttaggaaaactggccaatggaatagaacagagtccagtaacatccatgattcctggagatgaccgacgacagagaagcatcaaagattaaaagggaaacaaaagtttgcttttattcccaaaactgtgctcatatagctgattatccacatcgttaagaaatcaaggccgggtgtggtggttcacgcctgtaatcccagcacttagggaggccaaagtgggcagatcacgaggtcaggagtttgagaccatcctggccaacatggtgaaatccaatctctactaaaaatttaaaagttagccaggcgtggtggtgcacacctgtaatcccagctactcgggaggctgaggcaggagaatcgcagaactcaggtggcagaggttgcagtgagccgagatcaggccactgcactccagcctgggagacagaggaagactccatttctggggggggggggaaagaaagaaatcagaggctgggtgcagtggctcacatctgtaatcccagcatctataatcccagcactgtgggaggctgaggcaggcagattgcttgagcctaggagttcaagaccagcctgggcaacctggtgaaatcctgattctactaaaaatacaaaagagttaggtgggcatggtagtgtgcgcctatagtcccagctacgcgggaggctgaggcaggaggatcacttgagcccaggaggcagaagttgcaacaagctgagatcacgccactgcactccagtctgggtgacagagcgagatgctgtttcaaaagaaaaatataggtcaggcacagtgtctcatgcatgtaatcccagcactctgtgaggctgaggtgggtaggtcacttgagatcaggagttcgagaccagcctgcccaacggggtaggagggaggaaggggaggcaggggcctgaatccaaaccagataagaagacccccagcaaaggggactgtggcactgagatggaaagccccttccctcccctcctgcaggaagtgagtgctgggagatgagggtctggcagagactctggagacacaggaatttcaaacatgcagccattctctcccctcaagatgtttgcagctgggtgtggtgtaatcccagcactttgggtggcctcacgcctataatcccaacactttgggtagccaaggtgggcaaatcacttgagtccaggagttcaagaccggcctggccaacatggtaaaacacagtctctactaaaaacacaaaaaattagccgggcaggtggcacacatctgtagtcccaactactcgggaggctgaggcacaagaatcgcttgaactcaaggggcggaggctgcagtgggccgagatcgcgccactgtactccagcctgggtaacagagcaaaactgtctcaaaaaaaaaaaaaaaagatgcttgcaaaagttttaaggtacatgggatacctacatatttaagctgtatgaggcatgaggaaaacaagaaacttctggacagactgtatctcccagcctttcagggccaatgagacaaagatttaaggaagactgtcacctcacaaagagctctaccaggctctcagatggcacccctaaggggttacactgtagaaaaagggaaggatcaacaatagacgaagtctcatcaaaatgcaactcggctctgaccagctacttgccacctggatggagatggacagctcaccaccaccacatttcccatggaggaaaggaaagccctctctggaagaaaacaccctgctggagtctctggcttgtgatacacaatgagcagcacaccacacacactcagcacgccagtaacaaggacagacagacagacggtccacggaaaacacattgcagctgcagacccacatatgctaacccataattagaaaaaaaatcaatcaattaaaactgatgcagaaataagcaggtgatatgagttagtatataagaacattaaaagttaatatgggtcgggtgcagtggctcacgcctataaccccaacacttttggaggctgaggcgggaggactgctcgaggccaggagttcaagatcaacctggccaacatagtgacaccctgtctctttatttttttattttttatttttttgagacggagtcttgctctgtcacccaggctggagtgcagtggcacaatcttggctcattgcaagctctgcctcccaggtttacaccattctcctgcctcagcctcccgagtagctggaactacaggcgcctgccaccatgcccggctaactttttgtagttttagtagagacggggtttcaccgtgttagccaggatggtctcgatctcctgaccttgtgatccgcccgcctcagcctccgaaagggctgggattacaggcgtgagccactgcgcccagctgacaccctgtctctttaaaaaaaaaaaaaaaaaggaaaaaagaaacaaagaaaaaagttgtttttttttttttttttgagacagagtctagctctgttccccaggctggagtgcagtggcacgatcttaatgcaagctccgcctcccaggttcacgccattctcctgcctcagcctcccgagtagctgggactacaggtgcctgctaccacgcccggcttattttttgtattttttttttttagtagagacggggtttcaccgtgttagccaagatggtctcaatctcctgaccttgtgatccgcccatctcggcctcccaaagtgctgggattacaggcatgagccgccgcgcccggccgaaaaaagttaatataactgtatcccctatgttcaaagagttaagtagaaacacaggaagcaattaacaacttaaacttctggaatgaaaactacaatgtctgagatgaacaatatgctggatgagattaactgcagatgagacactgtagaagtccagatcaacgaatgtgaagactaaaagaaattatccaaaatgaaacactgaagaagactgaaatgaaatgaacagagtatcagtaaactgcgggacaacttcaggcagccaaatacatgtgtaactggagcccccaaaggagcgggaaacaccaaaaagagaaaacattgagtagctgcaattggcaggattctaaaaaaggtcccgaaacatctcccacggtcttctcatctccacccctatccttgagacagggtctcgctctgtcacccaggcctgtagtgcagtggcacaatcatggctaactgcagccttgacctccccagactcaggtgatcctcctacctcagcctcctgagtagctgggactacagttcatgccaccacatctactttttgtagagacacagtctcgctatgttgcccaggctggtcttgaagttctggactcaagcaatcctcctgccttggcctcccaaaatgctgggattacaggcatgagccaccatgccaaggacccatcttctcatctttagaaactgagactgtctgtgttgcaatggtcggatttggtgttactgatctcaaagccagtgcatgtagctccacttctggtgagaagccctacgccatggaagcatgagtagcgaatatccagccccagaaacgtgacagaagcctttagtgacaagcagggttcaaccacagctgacaaacggctgctataggcagaatgcacccaaattagaaaggtccaagacaggttcacaccattctccatgtacagagttctttttcttaccatacttttaccttataaaacacatcaggcacgtactgctcactgctagactccttggcgtagccaagctccggggcgtccttgcatggcagcaaacactcatcacggaccagtgccatacactgattggacacctggtacccttcaaagtggacttggttgtcaggaccacctgcaagagagagacctttaaaaagagtctaccaaacggcattcaaaaccagtccatatctgttaactcttcacctctgatcaacagaaaaaacaaaccctcaagagtttgtcgggggtaagagttaaaaaatgttcagtagtcggccgggtgcggtggctcatgcctgtaatcccagcactttgggaggctgagacaggcggatcacgaggtcaggagatcgagaccatcccggataacacggtgaaaccccgtccctactaaaaataaaaaaattagctgggtgcggtggcgggcgcctgtagtcccagctactcaggaggctgaggcaggagaatggcgtgaatggcgtgaacccgggaggtggagcttgcagtgagccgagattgtgccgctgcactccagcctgggtgacagactccatctcaaaaaaaaaaaaaaaaattcagtagtcaacggatgggtggccacagcacaagacctagcacaagacctagcacagtcaggacaccctgcagctccgcacacacttggctccacaaacaggtgccactaaggacatgctctatgagaatctggaaatcaagactgttaaacttttgaaaaaaagaaaagaaaaggctcagattacgcctgtaatctgagcactctgagagggcagggcgggaggactgcttgagcccaggagtttgagaccagtctgggcaacatagtgagaccctatctttacaataaatcaatcaatcaaaaaaaaaaaaaaaagattgttaaacattgtctagcatctgcccctaaaaccaggcttagtgtcatcagcacttgggctcctggttcataataacaccaggggtgtaaacggcagatagatccctaggctcacggtaaggatgggaggataaattcatctggaggcagagagatggggaagcgggtgggagaagagcaagacggaaactatttttaatacaaatccagtcatggtattgtatacacagcagcctctgtcttccagaaacctacacggccgccacacagagttaatgccaccaggcgtcatcacacagtgtggaggtgcaggtgccactccacggccgtgggcagacctgggagcccagctcctccatggtttcaccctccacactgcccaccccatccttctctcccagtctccactccatcgaagcctccagaatgacttcatgtggggacaggagaactacagatcatggctgagaggcggcagtgtggtccagttagaccagatccctgaagtgagctgggcagatgatgccatgggggcagcctgagcctttggaggaggcaggcatgggggagatgcccaccgctgcagaagtgtgcttccagaactgaagttatgtgctgactacaatctcattattttttaggtatttatttattgttttagaagtaaggtcttactatgttacccaggctggtctctaactcctggccccatgtgatcctcctgcctcagcttcccaaagagctggaattacaggtgtgagccactgtgcccagccctcaacatttgttatagttttggatgaaaaaaaaccctcaatacctctatttcagtttctttgacaaaaagaatcacttatgatcagaaaacagaaacgtagtgcacatggctgtcaaacatgcatcagaaagcaaacctgacggccacacaatcaaaaaaggtgagggaggagatagagctggccgccatgaagctctcaacacacataggaggcaagtgatggctggcttcaaaaccctgggtcaaactcgctccaaaggcacagttcaccagcataggattttctccctgccccaaactcaaatgctcaggaggcagccaaccctgcacaaatgaccactaatatctcagcaaagatacaggcacctcacttgcccatgtgcttggtggcataaatgacactgaaagaatgcagggctcagagggagcagaggcaaaggctggacagagcgccggggagccacggtgcagacatctggttaggacaccatgaaaacctggactgggcttggcgcagtggttcacgcctgtaattccagcactttgggaggccgaggcaggcagatcacctgaggtcaggagttcaagaccagcctggaaaacatggtgaaaccctgtctctactaaaaatataaaaattaactgggcatggtggcgtgcacctgtaatcccagctactcaggaggcagaggcaggagaatcgcttgaccccaggtagcagaggctgcgatgagctgagatcataccactgcactccagcccgggcaatggagcaagactccatctctggagtaaaacagaaaaaaaaaaaaaaaaaaaaaaaaacctgctctggtgtttagactggtcattaacacgataggtcattcaagaaagaaaaatctagcagttgagaataagagaaaaatggaaagcagttatttataaaactgaaggctgtttataaacagcaaaattggccatatggataatcttcaagggtaaattcactgagatgaactgcaaactcccctttccacatgcagcagcaggacatacatgtcctgatgggtttgtgtaaccctgccggaatggctggcaggacaagttaactatcattcccttcacaaatcagtcagtcaggaaatccctacgtgggaaggatcacagggcctacaaagaggcagtgacagcaaaacttcagctgctattgaatctgaatgcatttctggttttttaaccagatccccagcaagtaattttaacagcccgtaaatgtagagtatgctagactatgaggacacagatgcccagcccagtgtgtggggtaagttctacactgcactgtccttccacagggaccctcagggtcactcgagcaaagcgcacacttcattggggctcttatactctgaagcctcatgccagagaatacctgagtacaacgaaaggggaaaggggaggaaggacagatgcagagggagaggcgaggcctccgcatcccagccaggacctgagtgctgtcggcaggggcgccccgcaccctatgccacatggctcagtctgaaccttcctgtctaaggagggatgtgggacgggaatgcaacaagtacaatttccaacagcgctatggggtccccgcatggccgtgaccaagaaaccctaacacaggggaaagagcacactttacttgagttagaaaaccttcatccgagctgtagtgattaaaagcacgcatgaggataagcactcctcagtcggccaccaccctcgggaaagggagaccatggcaagtctgagcaccaagaggggtgattcacacagacacaaaggggctgtcactgcctatctgcttataaattaggttatttattatctctcagttctaaaacctttcagtaaataccaattccagaggtgaaaaaagcccaaggatgatctatataatctctcaactctcaacaagaggtatgactcaaattcaaggtggtagcccccaagttagaaactgtaattctaaaaatgtgccagttcttctggcccatggaataatttctccacagacacagtaattagactgggcacagtggctcacacctgtaatcccaggactttttgaggccgagacaggcggatcacttgaggccagaagctcgagaccagcctggccaacatggtgaaaccccgtctctacaaaaaatacaaaaattggccgggtgtgttggcatgcgcctgtaatcccagctacttgggagactgaggcacaagaatcatttgaacccggaggcagaagttgcagtgagccaagattgtgccatggcactccagcctgggtgacagaacaagactgtctcaaaaaaaattaaaaataaaaataaaagatcctcgatttcactcagaataaaatagtcattaaaaccacactgaaatactgtggaactgttccatatcccacaagactctgaatgcccgctacacacttgtgtaggcaaaaaccactacttacaatgatatgagattagaagcaattctgttttataaatagccacaaaacagacaggcacagttgtaatgcacactgaattctctgggactacaatagtgtaagctgaggcaagggcacactcttctgcttggaactgggtggggagctgctgagcctctcaggaagccatgttgctgacggcaaggccagctgagaggcctggacccagccctgtgctcagcccttgcccacacaggccagtacggatcctgctgtgctgtcctcacgagtcagtccagaagcactgacacacctaaacgtatgactttattctgtttctttcctatcactttcccctgatgttacagttaggatactactctgccttccatttcagaattctgtgtgtcggcagcctacattaactatgttacccatgaattttatttctgcatagtaaaggggtatcacaaagtgttctaaaaacaggagttgagtctgataggcttggaaactaccagcctacactactgtacccagatatcagcctacatgtggcaggggtgtggggatgtgacaccgagaagagtatgacgacacttttctccccgtctctaaatacaacgctggccaggcagaattctaaatgacatgagcgcctttgttctctgctcccctcctgggtgcccagtgcccactgcctgatgccccagctgctctccagctaccctgagtcccccacgacagcacccttcccagggtgccctaacaggttctgtaatgcagaattcccagaccctccttcaatcctagcccaaattcccaacccttcccttaagcactcaacccaagcaacaacttaggaaaataaatctgactcggccgggcgcagtggctcacgcctgtaatcccagcaccttggaaggccgaggcgggcggatcacgaggtcaggagatcgagaccatcctggctaacacggtgaaaccccgtctctactaaaaatacaaaaaaaattagccgggcatggtagcgggcacctgtagtcccagctactcgggaggctgaggcaggaaaatggcgtgaacccgggaggtggagcttgcagtgagccaagacagcgccactgcagtccagcctgggcgaaagagcgagactccgtctcaaaaaaaaaaaaaaaaaaaaaaaaaaaaaactgactcaactaattcacttgtaaaatagttaacatgtattaattattaacataattaacgtgtgaaagatgcctatcaccctcaaaaagtatattcatttcaaaaatcaatctaaatgcaccttaaatcaaggaactgcaggctgggcaacacagcaagacttcatttctactaaaaatttaaaaattaggccaggcgcagtggctcacgcctgtcatcccagcacttgggaggccgaggtgggcggatcacgaggtcaggagatcgagaccatcctggctagcatggtgaaaccccatctctactaaaaatacaaaaaattagccgggtatgctggcaggctcctatagtcccagctactcgggaggctgaggcaggagaattgcgtgaacccgggaggtggaacctgcagggagccgagatcgcgccactgcactccaacctgggcgagagcgagactccgtctctagggaaaaaaaaaaaattaaaaattaactgggcgtggtggcgcacgcgtgtagtcccaactacataggaggctgttggggtcggatcacatgagcccaggagtcgcaccagtgagctatgactgcaccactgtgctccagcctgggtgacagagcaagaacatgtctcaaaacaaacgaacaaacaaaaaaaaaaacacaaaaacccggcaaactcaagaatatgcagcaaagtgcaaaaacttcgcagtcagcttgaacacttttctttctttttttccaaatgttttatttatttatttttgtagagatggggacttgccatgttgcccaggctggtctcaaactcccagtctcaagggatcctcctggctcaacctcccaaaatgctatgattacagatgttgtaatcccagcactttgagaggccaatgagggtgactcacctgaggtcagttcaagattagcctggccaacaaggcaaaacccagtcgctactaaaaatacaaaaattagccaggcgtggtggtgtgcacttacaattccagctactctgaaggctggggcacaaaaatcgcttgaacccaggaggcggacgttgcagtgagccgagattgcgccactgcactccagcctaaatgacagtaagactgtcaaaaaaaaaaaaaaaaacccgttttgctttttttttttgagatggagtttcactctgtcgcccaggggaacatccttgtccatatatacatatacatatatatatatattttttttttcttttcttttctttttttgagacagaggctcaccctgtcacccaggctggagtgcactggcacaaactcagctcactgcaacctccgcctgatgggttcaagtgattctcctgcctcagctccttgagtagctgggattacaggcgcccaccaccatgcccagctaatttttatatttataaagagatggggtttcgctatgttggccaggctgatctcgaactcctgacctcaagcgatccactcacctgggcctcccaaagtgctgggattacaggcgtgagccaccacgcccggccaaaaaagtggacttttaatgagagcactggcctagaggagagctctgtggaggtcctgattctgttatgagttttggggtttgtgtttatatagttttatgctgttaagttgttcagaatttttaccataaaaagaaaggaggaatttatatcccacaagcccagtaagaaagtccagtataactaagttaaggataaaaagctaccaaaaagaggaacaaaatatattaacgaggtggtaatatttacagtacatactgtccctgttatacctgtagccactgcagtaacaaacttggatccaaaatgtccgtctggagagagccggcacatgttgggatgcttgttctggaagtctcctgcagtgatgcactcttctgaacttaggaaataggtgtcctaagacaagagaagcagcctatcaaattttacagcatcatgccaaaatatacttctatttcttctttaaaaaataagaactaagccaggagcagtgactcacacctctaattccagcactttgagaggtggaggcgggaggtccacttgaggacaagagttcgagaccagcctggccaacacaccaaaacctggtctctactaaaaataaaaaaattatctgggtatggtggtgcacacctgaacccaggaggaggaagctgtagtgagccgagattgtgccattgcactccaacctgtgcaacacagcaagactctgtctcaaaaaaataaaaataaaaaataagaaccaaactataaaactcaaaaccactttgaaacaagtatctacaattcctaaccattaccaattcctcatctaaaaccactcacgactagaaaggccagaagcactatgcaaaccaccccgccatgggctgagccctgaaaatcactgctttataaaggtaagatgggtttagctctatgagaccaagagatccggccttcattgatcaagaagaacttcttgaaaaataatggggcctgagggctgggcatggtggctcacacctgtaatcccagcactctgggaggccaaggcaggcagatcacaaggtcgagatcaagaccatcctggctaacacagtgaaaccccatctctattaaaaatacaaaaaaattagctgggcatggtggcaggcgcctgtagtcccagcttctcctgaggctgaggcaggagaatggcgtgaacccgggaggcattgctagcggtgagcagagattgcgccactgcactccagcctgggcaaaagagcaagactccgtctcaaaaaatacaaataaataaataatggggcctgaaagctagaaccagcggtgcaaagagaccctgataatgcaggccaacaccatctgtaaccaagccatagggccacacgcacagtcctgtctccacctcaccttatttcgactgtagcggacggtaccctttcgggtatcttctgagacgaggtctgtaaatatccagccaaccttaaaaaaaggaaagtagcttttaaacatctcctcaagatagacgatgaatggctgggcgcagtgactcacgcctataatcacagcactttgagaggccgaggcaggagaatcacgaggttaagagatcgagaccatcctggccaatacagtgaaaccccatctctactaaaaatacagaaattaggccgggtgcggtggctcacgcctgtaatcccagcactttgggaggccgaggcgggtggatcacccgaggtcgggagttcgagaccagcctgaccaacatggagaaaccctgtctctactaaaaatacaaaattagttggggtggtggcgcatgcctgtaatcccagctactcaggaggctgaggcaggagaatcacttgaacccgggaggcagaggttgcagtgtgccaggatcgcgccattgcactccagcctgggcaacaagaatgaaactccatctcaaaaaaaaaaaaaaaaaattagctgggcgtggccgggtgtggtggctcacgcctgtaattccaacacttcgggaggccaagacggtggatcacgaggtcaggagatcaagaccatcctggctaacatggtgaaatcccgtctctactaaaaatagaaaaaaattagccgggcgtggtggcgggtgcctgtagtcccagctactcaggaggctgaggcaggagaatggtgtgaacccgggaggtgaagcttgcagtgagccgagattgcgtcactgcactccagcctggcccacagagcaagactctgtctcaaaaaaaaaaaaaaaaaaaaagatagatgatgaatgttttctggcttctgcccagagagcttaaaaagaatgttctcagtcagaaactcctttttgtgagccaggtgaatctacatcaacaggttcctcaagtaagatgccaggccacacccagggatctccatctctgttcagtagaaactggccaccctccctctggtgctgctgggttagagatgagtttcctcagcaccagctctgcccagcaccatgctgggtgcaagagacacagcagtgagtgagaccaacagaaggtgagtgaaaaaggcacttaaactcccaagaggaagacagacaacaagcaagcaaataaacatttcagagagtaggtctttcctgacaagctaagaaaaaggattcctagagaaaggcacataatacaaaaggggtaatataatgcagacttcacacagctgctcctgggagctccacctcaaggccggaaggaagcatctgagggtatgaggatctgaaacctgtgacccagcaacccctgcacgttcagtgtagcagtgcctgtgtgctgtgtgatccttaggcccgcctctgcctgtgaattcctgcaccagaagcccgtcacgaggccacaggagcagcagttgagtcccggcaattgtcacttctgtcctcgggaaggatctgcggcccatgaccctctccagcactacctgacacacaactcttcccatccacccccagcagacatgactagcccactgggagactttcactgtctttaaagatgccccaatgaatgaaaaacccaaggtggtggcaacagagaaaatgaaacttaaagggttaattatgcagtaaataaagcaaaatcaaaatcaaactgagaaaaattagggcttagaaactcatattttaggccaggcacggtggctcacgcccataatcccagaactttgggagaccaaggcgggtggatcacctgaggtcgagagttcaagaccagcctggccaacatggtgaaacatcgtctctattaaaaatacaaaaattaactgggcgttgtggcgggtgcctgtaatcccagctacttgggaggctgaggcaggagaatcacttgaacccgggaggcagaggttgcagtgagccaagatcgtgccactgcactccagcctgggtgaaagagcaagactcctcaaaaaaaaaaaataaaataaaataaaaagagaaacttgtgtcttgcagaaaattatttaagtaatttcaagattatgaactgtaagattataacaaattaggtcaaaaaattggaccaatctcttttaaacaagagaacttccagaatttgaacccaaatatgcccctaaatcaagatgctgactccttgttagaaacaggatgtttctttcctaaagacagtaaaactgtgtggactgctcactgacactactaggttttaagtcacatttgcagtctcacccgcttcatctgtagagaagattaaataatctagagattatttttcatggtctgagttgattaggaaataaaggataaaacatacttattaacattaaactcgtaagatatgttcaaattcatggctctacattaatttattaaaattgttcctgggaactgtatcaatgtcagataaaccagatcaatagaataaaaaaggaaatccttttctcatcttctaactgttccatgaaactaggaagaattgtaggctcagagagctaaattataaacaggaaattaaatgatgattgatgacggagcagcagaagctccaagtgcatggcacagaacatgaacactgtcaatggaatgtcagccttgactgtcctcggcttccaagctacatgaagggagagctcaggcagaagggacacacatgcacagaggagccagcaggggtgcggctggggtctgtttcccacttgaagcagtcctcatgaagtgtggctggaaggctgaaatataacagccagatctgcactgggatttttttttttttatgctcaagaaaatgttctcattttagtttaagtcagaggaacataaaggttattggtgcccaacaaacatatgtgaagtttcaaaacatatagtgcctgcacctgaccttgtgcagccggagagagccagtacccgacacagcccggccactctcccaactccccctggcctggatgcccaacagagcctggccacgccccctgcttggctgccggatgcctcagtaccttccgcaggccaagtttggcagcaatttcatcgaccacttcagcttttggatcctcaagaagctccaagctgttctgtgtaccaatctgcagggaatcaaagggagaagatggacttagagcagagggctcaggaagcagcaccccaagcccttccacttccagctctaggtcacaaggagtgctgggggcctccttgtcagaaaggagaactatagccacagataaaacacatgcgacacgcctcccggcttctctccttctcgggttgtgctgcaccttttaccagggctgcaaaacatgtggcatgcagggcccagctgatgtgtgctgcacagctctgcatcaggagcactcaggactaaggcaaggcaaggtctacacactctgcctgttttaaaagttccttcatcagggaattaagttactttcaaacttccttggataagtagcttcactccaaacaggtttggctaaattaggcaagactcaaactgtaaggtaacatccattcccacaaaacagccttggaaaatctgtgtgccactcctgcagagacaatgcttggcttcacagctaagatactcagttacagggacactatgaactccacagagagcgatgagctcaccaaccctaaggaagggaaaaggtgttcaaaaatcaaccacctcctttcatctggcacagggcagtcgatgagttgtagcttcgactggctcccatgcaactgaaaccaaccacagcacatcacttcccagagtggaccaagcttaccgaaatcattaatgttcacttaaatgtagcttgcgggtcattcaaaggtatcattctatgcagaaaccccagccataagaataggaaaggtaaaggtaatctcaaattgagttacagtaactgggcatatccttgtaaattagtgaaaatctggcaaaccacaaagaagtttacgtttgctgggtattacccatatggaggtcattaatacctccagaacgtaggttaaatcacaaactcagagaaaaagctaaggaaaaggagttgtttaatgacatgtggcagcataagctgcataagcaaatttttgtgtgtgtatttttagtagaaacggggttttgccatgtcagccaggctagtcttgaactcctggcctcaagtgatctgccttgcccctacaaagtgctgggattatagatgtgagccaccacggctggcctcaattatacttttaatagaaccgttgagctctccatgaaagagaccctttaaaaaaactgaatctgaatactgtgtgcttcgaaaagcagcatcctgagtacagcacagtgacctaagggttgagacttcactggcggggtctctactgccatctagtgtctctttttaaaagaaccatggcaaaggcctcatgaaacactacatctattgctatacaaagataccaaaaatgtcactgaaaatccgtataaatacagccaagaaagacacacatttgtgcaggggccactagcaagcctgtacaccagctgttacccatgcatagcctgcagtttcagactctgatcagcaaactctgaaagcagctgcagggcaccccagcctgcctcccaggcaggttatctaaataggaggctagccatccggtgatctccacaagacagtgttaggtggaaaaagtgcacatattatacgtacaaagaaacaaagaagggggatagtatgaatgtgcgtgcatgcatgcgtgtgtgtatgtgcttacactaaaaatgtcacatacaaaaaaaacaaaactagccaggctcagtggcatacaccgatagtcccagctacttgggagaaagaggtaagaggatctcgctcaggagcgagaccttgtttcaaaacaaaacaaaacaaacaaacaaacaaacaaaaaacaaacttttgccaagcacaatggcttatgctggtaattctagtactttaggaggccaaggcagtaggatcacttgaggccaggagtttgagaccagcgtgggccacacagagaccctccctgtataaaaaaaaaaattaaacaattaaacaattaaaaaaaaatcaggccgggcgcagtggctcacgcctataatcccaacactttgtgaggctgaggcgggtggatcacgaggtcaggagtttgagaccagcctgaccaacatggtgaaaccctgtctctactaaaattacaaaaattagccaggcgtggtggcggcacctgtaatcccagctattcaggaggctgaggcaggagaatcacttgaacccggaaggcggaggttgaagtgagtggagatcatgccactgcactccagcctgggtgacagagtaaaactccgtctcaaaattaaaaaaaaaaaaaaaaatcaaacttcaggaagtccaactaaaaagatttaggctgagcatggtggcttatgcttgtaatcccagaattttggtaggctgaggcgagtgaactgtgtgagcccaggagttccagacaagcctgggtaacatggcgagatctgtctccacacacactatatatgtatatacacatacatacatatatatgtatatatacacacacacatatatatatacacacacatatatatacacacatatatatacacaaatacacacacacacacacacacacacacacacacacacatataaaagtcagacatggtggtgcacgcctgtagtcccagacacttgggaggctgaggcaggaggattgcttgagcccaagagggctgcaattgaggctgcattgagccatgatggcagtactgcactccagcctgagcaacagagtgagacgctgtctcaaaaagaaaaaggttttaaattctaggggctacctataaaggaaagcagggtaaaaggaaatgaatataccttgtttgtaaacatgactttggaaatgtgcactttttttttcttttctaacttttaaaaatatttctggctgggcacagtggctcctacctgtaatctcaacacttcaggaggccaagatgtgagggtcacttgaggccagtagttcaagaccaacctgggcaatatagcgagaccctgactctaccaaaaatttaaaaactagcttggcatggtggcatgcacctgtagtcccagctactcagaaggctgaggcaggaggatcgcttgagcccaggaggtcaaggatgcagtaagctatgactgcacaactgcactccagtctgggcaacagagcaagactcatctctaaaaaataaataaataaaaattaaaaatttctaacatacagctaatttaaagaattttacagtgaatactcatatacccaccactagattcaccatgaacatttcctatgcactatctgtccctctagtcacccatcaattcattttatttttctattggatttcaagtgtattacagacataaatgtacttctccctaaatagtacagcatgcatatcattaactagcattcaatatttgcttacttttttacttttgcaataaaatgtatgtaaaatacactacatcattatacataattacaaaacaaattgaaatttatataaatatacacacacagcccaattcccaaaaaccagaaatacaatgtgtaactagttggtggcataatcataccgagagggccttccaatgacttccaagcacagtgactagatgtgcacacaccctgcgggatataccctcaggacacttctttcccctccaaacaaatcttaaattgttatcagtcctattttggtggcagtttttgttactctggtgacactctggtgattggtgctgaggtgtgtctgtggccttctccatggttcctaagacagtgactgctgcatggtggaagagacacagaatgacacaaggactgagcacctggacactacagagtcaatgagcaaacctggacacagcagacgagataaaaacactggatcaatagtggcaaatgtaccggttgtgtaagaaaatatccttatccttagtaacatacactgaaggttttaggagccatgatctcactctccaataactcagaaaatgttgtgcacgtgcaccggtgtgtgacaaagggggaacaaacaacaaagcgaacagggcaaggcctctccgaaagggcgtcccccacagcctccaaacacagaaactcaggaacttgaatcccgtcatgtttacctgaggtggctcataaatcgcagccacttcagccctgatgccaaggggaatgtctttgtgctccgtgtaccgtccgtataagtacccaaaatgctggttccctgtctttctccagaagtcaagaaagcggtcagcgacggtgtgattctcaaacatgatattgtccacatgcctgtacttctgtagagttaacaagagtgggctgatgaaaacatgccatcaaaaagaaatcacttgtttttctaacacaaaccattcataaatatcttttacctagttctttaaaaaacaaaccaatagggtgtgatggtgcatgcctgtggtcccagatactcaggaggccgaggctagaggatcgcttaagcccaggagttcaagtccagcctgggtgacagagtgagaccccttgtatcttaaaaaataaacatctgggctgggcgcagtggctcacgcctgtaatcccagcactttgggaggccaaggcgggcggatcatgaggtcaggagatcaagaccatcctgaccaacatgatgaaatcccgtctctattttttttgtattttataaaaatacaaaaaattagccagagccaggcgtggtggcgggcgcctgtagtctcagttactcgggaggctgaggcaggagaatggcgtgaacccgggaggtggagctcgcagtgagctgagatggcgccactgcactccagcctgggcgacagagcaaaactccatctcaaaaaaaaaaaataaataataataataataatctgctattctatttaaaaataaaaacaataaacattacttaagaaaaaaaccagtcaggcacggtggctcatgcctgtaatcccagcactatgggaggtgaggcaggcggatctcttgagtccaggagttaaacctcaaaaattattcaatacagtgaaaccctgtctctactaaaaatacaaaaattagccaggcatggtggctcatgcctgtaatcccagctactccggaggctgaggcaatagaatcacttgcacctgggaggctgaggttgcagtgagccaagactgcaccactgcaattcagcctgggctacggagtgagactctgtctcaaaaaaaaaaaaaattgctctgccctttagaccacttcagagtccagtggcgggacacggggttataggaggatggagatgggtttcatctatcaataaattcaaaataattccattgtgatttaacctaaaatacaggttttcacaatctctagggcaaaaaacaaacattttctttttttttttttttgagacggagtctcgctctgtcacccaggctggagtgcagtggcgtgattttggctcactgcaacctctgccttcaggttcaagtgattctcctgcctcagcctcctgagcaactgggacgacaggcgcccatcactacgcccagctaattttttgtatttttagtagagatggggtttcaccatattggccaggctggtcttgaactcctgacctcaggtgatccgcccacctcaacctcccaaagtgctgggattacaggtgtgagccaccttgcccggccaaaataaagtagttttcaagaagaaaaaaggaatagagaataggaggtttccaaaaaagtcgaggaggccacggaattctctctaaggagccggccgttttctctaagggcacagcggcaggaggaaggcgaggcaggctactcagaggcgggacaaggacagcagaacatccagaaaggccggaacgctccctccttcctgagccacattctctccttaagccagcctggacaggtgctcagagctggtccaaggggtgcccctttaccaaccttcagagccagtttcctcacaaccactgaggattttaaataatcatcaggaacattctgcctccatatgagccagcaaaacagagaactgagggcgcgcactccatatctccaagagcaagaagccttaaaaatgatatattcagtgtaccacttccacaaaaggatcattcagtccatcaaaaagtactgaaaatccaccacgcatagtgctaatagcattccactccaaggggctcttctggaaatatccgtttctcagccatgaaaacaaatctagacagacagggaacatctcacctgtctgttcagcgtgatggcgctcggctggcacttagtacagatgccattcggccacgggaggtgcccctcgcaccctgacttaatcttgcagctgatgttctccagggcaacaaacttccccctacatagaagagaagcaacttaaacatcacattggtgaaaagttgagcaagaggctggaaatgacatgctaagtatcttatacctcctgaacagtgtctcaggagctaagcacgtggcagcagcagggaagatgggctaaggatgattctaatggaagctctacctacagttccagcacattccgaatcccagcttctgtcccacatacttcaaccatacaggaacacacaactactttcctaccaaactgtggtgttttttaccatctatcactaacatccgagaaagctttcaagaatactgtagaatatctactgatctcacctgtgccactgagcgggcatgaggctcctacaggtttcattaaattgtcagaaactttgacattagcccagtacttagatatttgtaaaaaattcttattcatgggaaaaatctgattaggatatataattaaggcatctttactctgctttaggctaaaataaaaactactgttgaagactgtcaatgagaaaatcctggaccctactctgaactttttctttttctccagctttattgaaatataactgacaaaaaaaaaaaaaaaagaaatctgtatctttaaggtagacgtgaggttttgtttttcaaataaaaacgatatatttacagtgtacgaaatgatattctgaaacatgtccacactgtggaacggctaaattgagctaattaacatatgcattacctcacatactgatcatttttggtggtgagccatttttggtatcatagcatctaggaagcaaagactcgtcactgaatctgcatgctaacagcagccacaaacacgcccccactagagactgtgttccttgacctagactgagaaaggctgaccaagtctctttcactacaatcaatctgcacccactccttagtccagagagttccacagctttccccactgacaagcaacagtgggtttctagcaggttttttcttctggtctaacatttttaaaaagtcattttaggatgtcagcaggttgtcagagaaaagctacaatcaggcgaatatgacatccttcacaaaatgttgctgacttcagttcagccaccatctcctcgttgcactgacaggaattataaaataatagctgaagcctgctactttctggtagggtgtacagagagccaacaggagaaggtcatacaggcaagggcttgccatggcttaaaagaaatcaaaatgctcagttcacccctttctggccactgttaccacctctgcccacctggctgagcctgtgggcaactactgtggtaccatgaggattagtggctgcagcccctgctgtggctgaaaaccaagctgactcagaggccaggctctggggaaagggttaccaggcactgaggtggggaagctgagattctcacagggtagttgtttttctgaaaagcagagaatgaactcagaccacagaatcaacaggccaccatcacagatgctaacttgctggggtggtgtgtgtggggacagcctctgtctgatactgcactgtggccacgcagccaggcgcctgcacagtcgctctgccttgctagctcccttctagaaccaggttggccaggcgaggtggctcacacctgtaatccagcactttggggaaaccaaggcaggaggatcacttgagccaaggagttctagaccagcctgggcaacatagtgagaccccatctcttaaaaacatatatgagtacataaaaaataaataaataaatatagaaccacggtaactttcaaaggcgtgtgaccccttctcatctttacttctctcattcacacgttcactggctataagcaacaactgccagctacacaaaaaggaatttacgcacaaccaggttacagcaagttgcttacttgtcagcccctccagtcagcttccggatgtaggcgtggaaggacatgtgcttcacgggaggctcgagatggtttagatagtcctcatcgaatggctgccaagacacagagtaagcgagtgcagtctcacacgtgccggtcactccaggcgctgagcctctgctacgcacagggggaggccagcagcatggccttggcaagtcaaggcccacagtgaaagcaggtactagggtctcccttaccactctgagtcagaaccaagtttttctttttttaattaattgttttttgtttgtttgttttgagacggagtctcactctgtcgcccaggctggagtgcagtggcacagtggcacagtctctgctcactacaacctccacctctgggttcaagcaactcttctgcctctgcctcccaagtagctaggactacaggtgcacgccaccacgcccagcttatttttgtatttttagtggagacggggtttcagcatattggccaggctggtctcaaactcctgacctcatgatccacccgccttggcctcccaaagtgttagctttacaggcgtgagccactgagtctggccaatttaactgttttagagatggggtctcatgctgttgcccaggttggagtatggtggtgcaatcatggctcactgcagcctcgacctcaagtgattctcttgcctcagcttcctgagtagctgggactacaggcgtgaaccaccacacccagctaattttttaaattttttgtagagacagggtatacaaaaaaagagttgcccaggctgaacaattcctaggctcaaatgatcctctggccctggcctcccaaagtgtcgggactacaggcgtcactgcacatagccagaagcaagtttttctttgtgtgccagttatcttttcaagattaaaatgaatctctattaaacacaaaacgctctaagtcaaatgagtttcaggaaaattgtgcaaaaagaaatgccacaagatgaggcaagagatgcctcatgaagaaaatcgggctggccttcctgctgtaaacccagcattaacagttccagtcggcattattacggtaactctcagtctcaccaggacaaaccagtagaagagatgtgagattcaaggcaaagtaaatcaacaatgataagcacggaggccgacaggctcagctttgtgtcagatcggaaaaggattgtccagggagcccgctgtaaatgctgcccctttatcacagccacacaaatgcttcagccattcataatccagcgagaaggtcactcccataaataaaggctcgtcctgtgtgcagcttgcactaggggaatatgaggcccagggcaataaataggtaagttctttgaaccactcactacagccaagtgcgtggactcagggcaagcacttaagacagctgtctacccgcagccccccacactggcccagaacttactccgcagagactctcacctctagagggacgcagtgcacgcatttccccaaagggccgtggcggcatctgaggagagtacaaggcagaaaaaggcagagcagtgaggatgtctgtgttccgctgctgctgtctcacatgcacgtcctactttaacagagtgtttccctgcccacgtggagttatattccagatggcacatggataaacatttatattttaattgttgttttgttttgtttaaagacaggctctcactctatcgcccaggctggagtgcagtggtgatcgtggctccctgcagccttcacctcctgggctcaagcactcccacctcagcctccccgagtatctgggactccaggtgtacaccaccacacccagaagtttactacttatgttgatatgaattagaaaaaactgacccgcacatcaaacctgtgacttcatgggtatccactgcttaaaatgacacaaaccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaatgacacaaaccaaagataaaagtgaatgaactcaaagtcaatgtaagtagtttattggccaaaggcagtggctcacacctctaatcccaacactttgggaggctgagatgggtggatcacctgaggtcaggagttaaagacaagcctggccaacatggtgaaaccccatctctactaaaaatacaaaaattagccggacgtggtggcaagcacctgtaatgccaggaaccagggaggctgaggcaggagaattgcttgaacctgggaggcaaaggttgcgatgagctgagattgtgccactgcactccagcctgggagacgagagtgaaattccactcaaataaataaataaataaaatagttttttttttgttttctttttttctgagacggagtttcactctgtcacccaggctggagtgcagaggtatgatctcggctccatgcaacctccgcctcctcgtttcaagcgattctcctgtctcagcctcccaagtagctgggactacaggtgcacaccaccatgcctggctaatttttgtatttttagtagagacgggatttcaccatattggtcaggctggtctcaaactcctgacctcaggtgatccacctgcctcagcctcccaaagtgctgggattacaggtgtgagcaactgcgcctggccaagtccatttaaagaaaagtgttaaataggccaggtgtggtggcttgcgccctgtaatcccagcactttgggaggccgaggcgggtggatcacaagtcaggagatagagaccatcctggcaaacacggtgaaaccccgtctttactaaaaatacaaaaaaattagccaggcgtggtggcgggcgcctgtagtcccagctacttgggaggctgaggcaggagaatggcgtgaaccggggggacgcagctggcagtgagcggacgtcgcgccactgcactccagcctgggtgacagagcgagagtccatctcaaaaaaaaaaaaaaaaagaaaagtgttaaataaataataacaaagctggtacgtgaacatggcaaagggcctgagagcggtgcataaataatccaagtttggaaaatacctacttcatatgcattttgggaaataacaacaatgaaaaaaccttgtcccacggctttctaacattttcagtcacagaagccttgggagcacaacacgcacaatctgaaggagaggtatgctggtttacgagggcgccggcggccgtccctccggggctcagtcagacccctttctaagtggggtcagaattcttacatgcgtatgagccctgtgctgcggaacagaggtggcctctgtgcttcctaataggcaggatctaagtgatgatggctcagaattctctcacacacacacgctctcaaaagctgctaatgaagccatgaagacacagatcatgcaagcaagccagtgccaggcccctgggaggagacacaaatggaagaggcatgccggctaatggctatggctacaaagtggctccatgccaatggcaggagagcaccatttatggctctctgatctaagacataaaagttgctaatgcagcatttggaatcccaatacctcaaagtcagcaccccgtcacatctacagagtgatgcattttaaaaaagaccccactgcagagacaaccttcgctcagacaatttcacatggccaagtataaactcagatccttctcactggtttatttaaaaggaattgcaaaaaatctaaaataaacaaatgtacatatgcataagcacttcatatagccccaggtgaggagggaatattccaaggcacagcatcttctgcaagtgaaatgcttgctgcagggatggagagcgcacactagcgtggcaggtcaaaatcatccaaccgctatgaaatgagagacacagcactcacctcacatggatgcgcacacacaaccacctgccccttccctcctccctcccctgcagctgctgattaacaccccactctgcacgggaatcagcatctccaggggacatcacagtaaagacttggtgtgaggcccccaactcccccaatacctttccagtctctttgtacccaaatgcttcaaaattttttatgggaacatattttgaggtggaaactgataaaaagctaaaaaaaaaaaaaaacaaaaactgataaaaagctaacaagataacttgaagtttaatctgaagatagtaaaacttaagacttaacatttcttcatcagatacttattaaaacaagacatgttataaatatttccctttattcacccattaagatcaccacaagtaggaccctggaatctcatggatcacttacagctgtgggtctcggcttctgtaaatcttcccgtcctgtttgctgaggtactgatcaatctcatcctccaccacgttgggagcgccaaagactttgaagcccggtggaactgacgtctccatttcagatgagggcccagcaaggctcgagggaaacaggaacaacaaatcgccatgcctgttcaaatgataaacagaggctgatgccttcccttaccacctgagcttcatggaagcccaacttggatatctgcaaaaagcaaatgccaaccacccctgtaggcctaaacaatgaggtttctaacttttaagatgagaattctcttctaacatctcccctatgtttcctggcattataaagaccagtatgcaggttctctgtaatttaatctcttacaactttaccttaaactctgtgaagcctccatacacccaaatgattttgcttgcacacacagccacaatggacctgctgggtttcagggcctctcctcccgcctctcaccctctgcttggcccccacctccctcagccattcctctggcctctgggaggctctctcctcccccaacactgcatgtgctggttgcatgtatctccactgctttctcggcgttcacatacacacgtaagcacagacacgcataggagctgtcactgcttttaaaaagtgtgactggccaggctcggtggctcatgcctgtaatcccagcactttgggaggctgaggcagatggatcacaaggtcaaaagatcaagaccatcctggccaacagggtgaaatctcgtctctattaaaaatacaaaaagactagctgggcgtggtggcgcacgcctgtagtcccagctactcgggaggctgaggcaggagaatcacttgaacccaggaggcggaggttacagtgagccaagatcacaccactgcactccagcctggtgacagagggaggctccatctcaaaaaaaaaaaaaaaaaaaaaaaaaaaagtgggattaccagagacatacttttctatttcaacaacccctcataaaatcctccaaatataaggagtccacgtctaattgctatgacaatggctgcctcaattccccagtgaggctgcttaaccaccccctcagccactcctcccacaatgacaagtatgcacaccatctgccagcttctgccatcatcaccaccacccaaaaaggcccacggacagacgtccctgtggttttccttctaaagggcaaattcccaggagtcagacttaagggtactgctttccaaaaaggttgccacaagtcacatctggttttctatcactttcagtctgaagtgtgttcttcccttggtcagagtcacgctgccaacttggtgccaggtttgactggcatggcaaactgctgacctcagaggctaacaagcatctccactcacagtccacagaagccgcctggggtcccaagtgaccagagatggctgccaacactaaccctccaggccagccttggaagaaaggctgcagcatgtcctctgacagatatctaactgctgccaacaagacacacacacaggggacagactgagagggcaggatccacagctctaaaccaacacggtgaaggaagagcagaggccaaagtgcaggccctcaaggacacacagacactggggctcaggtgcagctcttcaactaatttctttcctcctcctcttcctccctaatttgggggtgatgaacattaccaaacattaccacatcagagacgtctgtttctttctttttttttttttttttttgagacagagtcttgctctgtcacccaggctggagtgcagtggcgtgatcttggctcactggaacctgcatctcacgggtttaagcgattctcctgcctcagcctcccaagtagctgggattacagacatgtgccaccacgcccagatactttttgtatttttaatagagacggggtttctccatgttggacaggctggtctcgaactcctgacctcaggtgatccacctgcctcggcctcccaaagtgctaggattacagtcgtgagccaccacgtccagccgagacgtctgtttctaatagcagattacatattcctaaacaccatctaactactaatataaaaaacttgacttacacacaagatcaattttaacaaatatactctaaaatcaattgatgagctctaaagaaagtagaggaaatccccaggggacaaacccagcagtgcactcagacagcagccagcaacacagaactcagagctgcttgtggggccaaggccactctcagtaattcactcacagctttgggcctacagcggtttgctgggcactgggagacaagaacttgggcttccctgcccagagggggcagctgagtccgaaacttccacataaatgcagataaccaaaggacgcctgaacagctgtgaaaaacccaccagctgaaaataggaaccaaggaggaatcccatctgcctctatccagtacacagcaaaaaaaaccaacaaagtcacctctgagactctgtaactaaaggcctgctgggccatgcatctggagcagaaccagggatgatgccatttggttcagaaagcccaaagacagaaattaactcaaaggagttgtaggtccatcacacccccctgtgccaacaaaagcaaatgcaaacctctgtagaaaagctgctaaatctgggccgggcgtggtggctcacgcctgtaatcccagcactttgggaggctgaggtgggaggatcacgaggtcaagagattgagaccatcctggccagcacagtgaaacctcgtctctgctaaaaataaaaaaaaaaattagccgggggtggtggcgggcacctgtaatcccagctactcaggaggctgagacaggagaatggcatgaacccaggaggcggagcttgcagtgagctgagatcgcaccactgcactccagcctgggcgacatagcaagactccgtctcaaaaaaaaaaaaaaaaaaaaagaaacaaaaagaaaagaaaagctgctaaatctggatccttcaggattcctcaagaccaagtttggtcaaatataacctgtcataagaaccaaaaatccaaatgtagaagagtaacacacgggccaggcacagtggctcacacctgtaatcccagcacgttgggaggccgaggcgggaggatcatgaggtcaggagattgagacgatcctggctaacacggtgaaaccccgtctctactaaaaatagaaaaaattagccgggcatggtggcaggtgcctgtagtcccagctactcgggaggctgaggcaggagaatggggtgaacccagggggcggagcttgcagtgagccaagatggtgccactgccctccagcctgggcgacagagcaagactccatctcaaaaaaaaaaagagtaacacactaccacgcaagtaagagtgggcagagacataattaacagagagttagactgccaaagactcacacacagaaattatgagaccgaatatcaacctctacatgggatattaaatgaacaatggaatggaagaagagggtgagtgacagaggctatccaaaatgaccaggtgggattctaggacatggaagtggcaggcaccaaagtcagtggctcttcccaaatctccctcctgcaggcagctagaccgcatgccaggtcccacggatgcatctacagcaatgcagggggcagggatacaagtgggggcagacagatgccaacagtcacgagacccaagaggcaggcccccatgtctcacagcccggatagggagtcctcaaccacccagtggtcttcactggaggccagtgggccaatgtggcagcagagcagaaactaggagaaaccaggagccacatggcccctgtgagtacttgaagccaacagacagatttaggggaaaaaaaaatcagattatgtatttatttatatacttttgagacagggtcttgctctgttgcccagctgcagtgcagtggcacaatcacagttcacaacagtgtggacaaagaccctgtctctaaagaaaaaaagagggtgccaggtgtagtggctcactcctgtaatcccagcactctgggaggctgaggccagcagatcacctgaggttaggagttcaagactagcctgaccaacacagagaaaccccaagtctacttaaaaatacaaaattaggccgggcacagtggctcatgcctgtaatcccagcactttgggaggctgaagcaggtggatcacaaggtcgggagatcgagaccatcctggctaacacggtgagatcccgtctctattaaaaacacaaaaaatgcccccctccccctccccctccccctccgtctctttccacggtctccctctcatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagatggggtttcgctgtgttggccgggctggtctccagctcctaaccaagtgatccgccagcctcggcctcccgaggtgccgggattgcagacggagtctcgttcactcagtgctcaatggtgcccaggctggagtgcagtggcgtgatctcggctcgctacaacctctacctcccagccgcctgccttggcctcccaaagtgccgagactgcagcctctgcccggccgccaccccgtctgggaagtgaggagcctctctgcctggccgcccatcgtctgggatgtgacgagcccctctgcctggctgcccagtctggaaagtgaggagcgtctctgcccggccgccatcccatctaggaagtgaggagcgcctctttccggccgccatcccatctaggaagtgaggagtgtctctgcccggccgcccatcgtctgagatgtggggagcgcctctgccccgccgccccgtctgggatgtgaggagcgcctctgcctggccgcgaccccgtctgggaggtgaggagcgtctctgcctggccgccccgtctgagaagtgaggagcccctccgccccgcagccgccccgtctgggaagtgaggagcgtctccgcctggcagccgccccgtccgggaggaaggtgggggggtgagcgaccccgcccggccagccgccccgtccgggagggaggtgaggggtcagccccccgcccagccagccgcccgtctgggaggtgaggggcgcctctgcccagccgcccctactgggaagtgaggagcccctctgcccggccaccaccccgtctgggaggtgtacccaacagctcattgagaacgggccatgatgacaatggcggttttgtggaatagaaaagggggaaaggtggggaaaagattgagaaatcggatggttgctgtatctgtgtagaaggaagtagacatgggagacttttcattttgttctgtactaagaaaaattcttctgccttgggatcctgttgatctatgaccttaccccaaccctgtgctctctgaaacatgtgctgtgtccactcagggttaaatggattaagggcggtgcaagatgtgctttgttaaacagatgcttgaaggcagcatgctggttaagagtcatcaccactccctaatctcaagtacccagggacacaaacactgcggaaggccgcagggtcctctgcctaggaaaaccagagacctttgttcacttgtttggctgctgaccttccctccactattgtcctatgaccctgccaaatccccctctgcgagaaacacccaagaatgatcaattaaaaaaaaaaaaaaaacacaaaaaattagccgggcatgttggcgggcgcctgtagtcccagctattcgggaggctgaggcaggagaatggcatgaacccgggaggtggagcttgcagtgagctgaaatcgcgccactggactctagcctgggcaacacagtgagactccgtctcaaaaaacaaaaacaaaaacaaaattagccgggcgtggtggcacatgcctgtaatcccagctactcgggaggctaaggcaggagaatcgcttgaacccgggggggcagaggttgtggtgagctgagaccatgccactgcactctagcctgggcaacaagaatgaaactctgtctcaagaaaaaaaaaaaaaaaagaaagaaaagaaaagaaaaaaggcggggtgccaggcgcagtggcttacatctgtaatgccaacactttgggaggctgaggcgggtgaatcacttgaggtcaagagattgagatcagcctggccaacacggtgaaaccctgtctctactaaaaatacaaaaattacctgggaatggtggtgggcacctgtaatcccagctactcaggaggctgaggcaggagaatcgcttgaacctgggaggcagaggttgcagtgagctgagatcgcgccactgcactccagcctgggcaacagattgagactccgtctcaaaaaaaaaaaaaaggtgggggtacagcaccccatggtcctgctgagggaatggcctgagtctgtcaggcctctgtttaccgctttgcatcggcaggaaatccaggacacagagggtcatgctggagggtcttgtgaatgtgaaatcagcaagacctcagaggtgggaaactctacaggtcaatggaccaagttcctcaacagataaatttcaagaaaaggaaagagatggaaggggaacctgaagattacaagaagtaagacatacaaatttccttaaaaagcaagactaactggcagtgtctagggatagacactcaagtaacgaaagaataaagagccaggcacggtggctcacacctgtaatcccagcactttggaaggccaaggcgggtggatcacgaggtcaggaattcgagaccagcttggccaacttagtgaaaccccacctctacataaaataaaaaaattagccaggcatggtggcacgagcctatagtcccagctactcaggaggctgaggcaggagaaatgcttgaacccgggaggcagaggttgcagtgagctgggatcacgtcattgcactccagcctgggcgacagagcgagactccgtctcaaaaaaaataaataaataaaaaaatgcaaaccggtgattactgttagggaagcttctgcagtggctgccaatgccttatccccagacctgcttggtgcttgcaatggtgacacataaggttcatccatcaaggcatacactgttttctgaggtgttcagtacgtattttgtttaataattaaaaagaggagggagaaaaaaaggccaagcaacagaagagaaggaaggagggcaagagcagcgggacaagcgtggtcgtgagctgagagttcctctggctggaacagagagcgtgcactcacagtcattctctttacctttagataatggttacgtgttccagatttaaacttttttttaaaaaattaccagctagatttgatttaaaagtgaaaaatgtgcctgtagtcccagctactcgggaggctgaggctgaaggatcacttgagcccagaaggtcgaggctgcagtgagctacgatcgcaccaccgcactccagcctgggtgacacggtgagattctgtctcaagaaaaggaaagaaaggaaaaggaaaagaaaggaaggaaggaaggaagtatcaagatgcaaaacccttcaagaaagaaagaaaaggaaagaaggaaggaaggaaagaaaagaaaaaaaaaagaaaaatatcaagatgcaaaacccctcaccagctcaaaagaaggatgaaccagtgtcactctggaaatgaacatcaacaacaagaggtttcgtttcacctcaccacatgggtaggcaaacagtaggtgcccaataaatctttgttaagaacaaatgaatgctacaattgcatgttgtgtccctagacatagtaatttgtgaatctaaaagtgaccaagtgcaaaaccagcccatcattctggctggtaaacaggctcacagccaactgccagcaggtcccaggcccaccactgagccagcggccacagcacatgcaacctgcagcgtcgagaggaaaactggccactagctccttaaggactgaactgatctaaggcacatgtgagcaagtgcccagatggtttcgatgggagccagcacccgtgttccgtaaaggaccagtcaatactttcagctttgcaggcctcacggtctatcacaactaaactctgcccttgtaacatgaaaactggcaccaacaacacgacctggctgtgttccaataacactttacaaaaacaggcagtagccaggctgtgacaagaggtctctgagtcctgaaggtcctgaatgaccaactctacagggtggcatgggccactgcagtggcagcactcctacccaagccagcagggctaacatgatttcccggcacacagctgtgttcaaggtctttcactccagacaagcagctgagtatgcagctcactccacgccgtacatggacaaagacaataactttctcctcagtgacacaaattccagaattctgcaaagtcaatcaaatctgctcaatagtaactgcagattcaggataattactgaattcctggcaagcaacacggtcatgtgtattctggtcagttgataagaccataatgagtggtgtgatgaggaaagaggataaaactcggcaacctcgggcagatcatggggacctcatttccccccattccctgcttcctcctcagaggacacttacttgatttttagcaagttgagggatttgttggaggaggctgttatctctccagtcttgtttctattgatgtaaaccgagaagccattattttggaagccaaactcctttgcaacctaaaacaaggcccaaagaacagaaatttaatgaaatgctaaagtatcactacatataccatacacgccagacactactagaagagtattcaccaaatttggaaagtgcccatcatttaccaaattcctcttgctattttgctcttttaaagaaatttgtactgttcacaaaggtgtcaattaaaatgaataaagtggccaaaaaagcaaaggtcttgtcaatgatgaaactttgtaaaacatttaagactttgaagcaaacaagagttaatggctatccttgttttgttttcagacagtctcgttctgtagcccaagctggagtacagtggcatgatctcggcatactgcaacctccacatcccaggttccagtgattctcctgcctcagcctcccaagtagctgggattacaggcgcctgccaccacacccggctgatttttgtatttttagtagagatggagtttcaccatgttggccacggtggtctcaaactcctgacctcaggtgatccgcccaccttggcctcccaaagtactgggattacaggcgtgagccaccatgcatggccaatggctatgtttgaaaagttcaatttccatttttgaattcaattgtaaaaacccaattccaggccaggcgtggtggctcatgcctgtaatcccagcactttgggaggatgaggtgggagtatcacctgaggttaggagttcgagaccagcctgaccaacatggtgaatccccgtttctactaaaactacaaaattagccaggcatggtggcacatgcctgtaatcccagctacccgtgaggctgaagcaggagaatcacttgaagctgggaggcagaggttgcagggagccgagatcgtgctattccactccagcttgggcaacaagagcaaaactctggccgggtgtggaggctcacacctgtaatctcagcactatgggaggccaaagcaggtggatcacgaggccaggagttcgacaccagcctggtcaacatagtgaaaccgtctctactaaaaatacaaaaattagccaggcatggtggcgcacacctgtaatcccagctacccgggaggctgaggcagaactgcttgggcctgggaggtagaggctgcagtgagtcgagatcatgccactgcactccagcctgggtgacagagcaagactttgtttcaaaaaaaaaaaaaaaaaaaagcaaaactctgtctcaaaaaaataaaaaacccggccgggcgcggtggctgacgcctgtaatcccagcattttgggaggccgaggcaggcggatcatgaggtcaggagatcgagaccatcctggctaacacggtgaaaccccgtctctactaaaaatacaaaaaattagccgggcgtggtggtgggcgcctgcagtcccagctactcgggaggctgaggcaggagagtggcgtgaacccgggaggcggagcttgcagtgagccgagatcgcgccactgcactccagccaggacgacagagcgagactccgtctcaaaaaaaaaaacaaaactcaattccaattctgaaacctaacacagaatggtgcgactaaatcataaaacgtccactgtgcagggcactttgctagatgctgggaatattcactcattccttcaacaaatattaagcagttctatgtgctcagctccattctgggtgttcagatcacaaaaatgaactagaaaagacaaggtttctggccgggcgtggtggctcatgtctgcaatcccagcacttcgggaggccaaggcgggtggatcacttcaagtcaggagttcaagaccagcctgaccaacatggtgaaaccccatctctcctaaaaatacaaaaattaggccaggtgtggtgactcacgcctgtaatcccagcactctgggaggccgaggtgggcggatcacgaggtcaggagatcgaggccagcctggccaccttgatgaaaccccatttctactaaaatacaaaaattagctaggcgtggtggcggacacttgttatcccagctactcaggaggctgcggcaagagaattgcttgaaaccagaaggcagaggttgcagtgagccaagatggcgccattgcactccagcctgggcgacaagagtgaaactccgtctcaaaaaaacaaaaacaaaaacaaagacaaaaattagccaggcatggtggtgcacgcctacagtcccagctagtcggtgggctgagacaggagaatcacttcgacctgggaggcggagctgcagtgagatgagatcacgccattacactctagcctgggcaacggaacaagactccacctcaaaaaaagaaaaacaaaaaaaagacaaggttcctgctgtcaagcagtttaccaacaaatgggggagacaaagtcaacaaaggtcgaaataagcactacgacagaaaaggaaaagaaacctcagatgggaggctagaagtctctctgaagagcttcagctgagcagggcccacccagcggtgggtaagcccgccacacgcgagctgggagaaaaggccacagggagtaggagcaagcacaaagaccaggaggcaggaagggtgttggaaacacggaggccagaggccaataaacaataaggaagatggaaagagatgaggctggcgaggcagacagggccgtgggaagccacacagacgaaaggcagggggaatcatcatccacaaaatccctgttgctcaacaccacactgaagaggaagctagagtgccaattagagacaagagagatgggctgagacaggggatgagatgggacaggatggtggggatgaaggcaagagcacactttccagcagtggtcatcaccaggcccagctgacgagcaggaccaggggcaggaatggaatgagagaaaggaaggaggtcagagtaaagctgagaattctagattgagaaactatgtggaggtaacacctgtgcagggaccatgaaaggaaaggctaaaaaaggaagaagactagagggaaaatcaggacttccatttgacactgagatcggaggtgacaaccagacacactgcagtgaagccgtccagcaggcaggtgggcgcatctgtgtctgagcccaggcaaggggccagagcaagagctctacaccgaggggtcatcagagtagatgtacccaaataaaaggaatgtgaatctcggtaaagaaacaaatcataaaagaacaatcaaatggaaattctagaactgaaaaacacaagaacagaaataaaaaattcactgaacgggcttatcagcagaagggagagagcagaagagtcaacctaaacataggtgaatagcttgtggtcccagcaactcggaaggctgaggtggaagcactgcttgagcccagaagtttaaggctacaatgagatatgatcacaccactgcactccagcctgagcgacagagtgagaatccaaccaactctaaaaagaaaaacataaatgaatcaataaaaataacagctatataatctgaaggcagagatttggggaaaaaaaaaacagccttaggaacccatggtacaggatcaaatgctcctcactagaaaaaaatgagggttgggcgcggaggttcaagcctgtaatcccaacactttgggaggccgagttgggcagatcacctgaagtcaggagtttgagaccagcctggccaacatggtgaaatcccatctctactaaaaatacaaaaattagacaggtgtggtggtgcacccctgtaatcccagctactcaggaggctgaaacaggagaatcgcttgaacctgggaggtggaggttgcagtgggcagagattgcgccactgcactccagcccaagcgacagagtgagacttcatctcaaaaaaaaaaaaaaaaaattagccaggtgagctggcacgtgcctgtaatctcagttactcgggaggctgagccaggaaaaccgcttgaaccccggaggcggaggttgcagtcagccaagatcgcgccactgcactccagcctgggcaacagagcgagactccatctcaagaaaaaaaaaaaagaaaagaatgaaaatagaacagaaaaatacttaagagtggggaaaaccccaaaatttaatgaaaaacatcaaatagcaactccaggaagttcagcaaactctctcaagttaagatacaaagaacaccactgcaaggcacaccagagtcaccctactgaaagccagaggtcaacgaagacgagaagaccaagaagacggtggaacgacagcttcaaatgctcaacaggaccaggcaccgcggctcccgcctggaatcccagcatccaggagacagagtggggaggatcacttgaggaaatcaagaccagcctagacaacatggtgaaaccccatctctaccaaaaaattaagaaattagctaggaagctcacgtgggaggatcgtttgagcccgggaagtcaaggctgcagtgagctgtgactttgccagtgcactccaacctaggcaaaaataataataataataattttaaaatggactgggtgagggtggatcatacctgtaatcccagcactttgggaggctgaggcgggcggatcacctgagatcaggaattcgagaccagactggccaacatagtgaaacctcgtctctactaaaaatacaaaaatcagctgggcatggtggtgcgagcctgtagtcccagctactcgggaggctgaggcaacagaatcacttgaacccgggaggcggaggttgcagtgaggcaagattgtgccgctgcactccagcttgggcgacacaatgagacttcgtctcaaaaaaaaaaaagaaaaagggccaggtgtggtggctcactcttgtaatcccggcacattgggaggccgaggcaggcggatcatgaggtcaggagatcgagaccatcctcactaacacagtgaaaccccatctctactaaaaacacaaaaaacattagccgggcatggtggcgggtgcctgtagtcccagctactcgggaggctgaggcagggaaatggcatgaacctgggaggcagagcttgcagtgagccgagatcgcgccactgcattccagcctgggcaacagaaagactccgtctcaaaaaaaaaaaaaaattgatgcatggtggggaacaaaaatgaactgtcaactcagaaatctgttttgaggccaggtgcagtggctcacgcctgtaaccccagcactttgggaggccaaggcgggtggatcacctgaggtcaggagttcgagaccagcctgaccaacatggtgaaactccatctctattaaaaagacaaacttagccggacttggtggcgtatgcctgtaatcccagctactcggaaggctgaggcagaattgcttgaacccgggaggctgaggcaggagaattgcttgaacacaggaggcagaggctgcaatgagccaagatcatgccatcacactccagcctgggcaacaagagcgaaactctgtctcaaaaaacaaaaacaaaaattagccaggtattgtggtgcacacctgtaatcccagctacttgggaggctgaggcaggagaactgctggaacccaggaggcggaggttgcactgagccgagatcacgccaccacattccagcctgggcgacagaaaaagactccatctcaaaaaaagaaatttgtattgaatgaaaatatccttgggaggccaaggcgggcagatcacgaggtcaggagatgaagaccatcctggctaacatggtgaaatcccgtctctactaaaaatacaaaaaattagccaggcatggtggtgggcgcctgtagtccagctactcgggaggctgaggcaggagagtggcgtgaacccgggaggcggagcttgcagtgagccaagatcatgccactgcattccagccttggagacagagcgagactccctctcataaaaaaaaaaagaaaaaaaaaagaaaaagaaaatatatccttcatggctgggcacggtggctcacactgaagcgggtggatcacgaggtcgggagttcaagaccagcatggtgaagatagtgaaaccccgtctctactaaaaatacaaaaaattagtcaggtatggtggcgggtgcctgtaatcctagctactcgagaggcttaggcagaggattgcttgaacccaggaggcagaggttgcagtgagccgagatcatgccactgcactccagcctgggcaacagagtgagatgccatctcaaaaaaaaagaaaataaccctcatataaacacagggcaaaacgaaaacattttcaggtcaaaaaaacccaaaggtctgtgaccaacaaacctacctacaacaaaggctaatggatgtttttcagtctgaagagaaacaacaccagacagaaatagtctgggggaatccatgggaaaagtaaataaggaagaaactgtgaagataagctaagaagtacataatatgcaactatcacagtaaatgaaatattttgtgattggttaaaaaaagaaaaactgtcatgggaatcctggacacaatgcaggtcaggagaccagggaggagccagggatgattctttgagtcaactgtagtcatatctacaattcatacttttttttttttttgagacagtctcactctgtcgcccaggctggagtgcagtggcgcgatctcagctcactgcaagctccgcctcctgggttcacatcattctcctgcctcagcctcaccagcagctgggactacaggtgcccgccaccacacccggctaattttttgtatttttactagagatagggtttcaccatgttagccaggatggtctcaatctcctgaccttgtgatccgcccgcctcggcctcccaaagtgctgcgattacaggcgtcagccactgcgcctggccactcttatgaaatacttttttttttttttttttgagatggagtctcactctgttgcccaggttggagtgcagtggcaccacctcgactcactgtaaactctgccttctgagtcaagcaattctcttgcctcagcttcccaagtagctgggattacaggcacctaccaccacgcccgactaatttttgtatttttagtagacggggtttcaccatcttggccaggctggtcttgaactcctcacttcgtgatccacccgccttggtctcccgaagtgctgggattacaggtgtgagccaccacgcccagccgtgaaatatttttacacttacctttgggctcttggtcctataattttgagcagtgatcagctgtgacaaacatctcatcctatagcaatccaacccaactgtgatagagaaaggcaatgcaagaggcaatttgggaatagggaaaataagaaaacgaggaaaagagaaaaggtatcgatggcagtaagagtagaggatgaaaaatatcctgagggtcaatacccaggccacagatacctttttcaaaaatgttgctgctgtttctctctttgttgctgtgatccgcttcactccatccggggactggacacgaattatctgttgcaaacaaaacatgatggttactgcacagcctagtgaggtcctgatctaatactacggcttccatctgtggtcttttagcatctgggtcactgaaaattaaagccaaacctcactcttcacctttcaatacccagctcaatccttctagaatatgatgccgaggggtgagattcatcaacatatggggagatattttaagagtactgtcctctcaactcttagtttcactcagaaaacaactttaattcctaatcactatttatagagtatatgtaaaacactttttgtctcttcagacttaaaacagagaaaaacccaccatgaaccatgaatgaactgtgttctttaaaaaagatgttactttggggaaaaaaaaaaaaaaaagatgttactttgttccaggatctatatacaaacattagacagtcttcaagagtcctacaatttaaaagaatcacaggaaattttctaattgttactttttttttgcttttttgagacagggtcttgctgtcacccaggctggagtgcagtggcaaaatcacagcttactgcagccttgacatccaaggttcaagtgatcctctgacctcagcctcccgagagctggaaccacaggcttgcaccaccacaccaggttaatttttttttttgtagtgacggagtgtcatatttcccaggctgatctcgagctccggggctcaagtgatcctgccactgtgctgggattacaggtgtgagccacaacgccagctattacttactttccctaaaaaacgtttaaaaatggccagacacagtggctcacgtctgtaattgtagcactttgggaggccaaggcggtggatcacttgagctcagaagttcaagaccagtgggcaacatggggaaaccccatctctactaaaaatacaagttagccaggcatggtggcgtacgcctatggtctcagctacttggggagctgaggcacgaggatcacttaaaccagggaggtcgaggctacagtgagccaagatggtgccactgcactccagcattggtgacaaagtgagaccctgtctcaaaaaaagagattaggctgggcacagtggctcctgcctgtaatcccagcactttgggaggccaatgcgggcagatcacctgaggtcaggagttcgagaccagcctggccaacatggtgaaaccccgtctctactaaaaatacaaaaattagctgggcgtggtggcgggcacctgtaatcccagctacccgggaggctgaggcaggagaatcgcttgaacccaggaggcagaggttgcagtgagccaagatcgtgccattgcgtgacgaagagcaagacttcgtctcaaaaaaaaagtaaaaatttaaacttaaaaaagaaattaaaattaaaagcaataaaggtctttaatggtaaaatttagtagggttttgaaaaaatattttcagctgggcacagtggctcacacctataatctgtgcacttcaggagaccaaggcaggaagatctctttagcctaggaattcgagatcagcctggccaacacagcgagaccccatcctaatttaataacgtgtgtgtgcatatatgcatattaaagtgtacatatatatatatatattttttttttttttttttttttttttcccccacggcaagcctaaaaaggttggcagatctggaagactactggacaaagggcattactttctaagacaacttgatgtttatgctgatgaaagccatcgtgaaggtgagttatcatgcctggccaacagcacaggcccctgctttagacaaggaggatgacatggcatgctctgcagcaaacaaagacctgctccaaccatccgcgggacgggaaggaaggcagacaggaacatgcgcataagtgtcctagcttctcctctcagcaaagactgatggtgcattctatagcttctttctctctcatttcctgcattaccatctcttgtatttagctcattttttttttccccgagatgaagtttcaatcttgtggcccaggctggagtacaatggcgcaatcttggctcactgcaacctctgcctcttgagttcaagtgattctcctgcctcagcctcctgagtagctggaatcacaggcgcccaccaccatacccagctaattttcttttttttgagacagtctttttccgttgcccagggtggagtgcagtggcgcaatctcggctcactgcaacctccactcactgcaacctccgcctcccaggttcaggcgattctcctgtctcagcctcctgagcagctgggattacaggcgtgcaccaccaagcccagctaatttttgtatttttagtagagacggggtttcaacatgttagtcaatctggtcttaaacgcctacctcaggtgatccacctgcctcagcctcctaaagtgctgggattataggcatgagccaccaaccctggcctagctgattttttatagtgaaacatttcaattcccttatttccttttttatttcttttttttttttcagctcttgttgcccaggctggagtgcaatggcgtgatctcggctcactgcaacctctgcctccccggttcaagtgattctcctgtctcagcctcctgagtatctgggattacaagtgcctgccaccacgcctggctaatttttagtatttttagtagagatgggatttcaccacgttggccaggctggtctcgaactcctgacctcaagttatccacccacctgggcctcccaaagtgctgggattacaggtgtgcaccaccacacccggcctcccttatttcctttttcataaattctataactattttctgtgaggttaccacgagtgttacattaaacatcctcttcaaccattatgcagatgaaaactgtcacaagccattgtctaaaaaagatttccactgatacaggacaaaacaccataaaggctcagtctactgggatttgtccgcttttagtaaagtaactaagcctaatctagattttcctaaaataggataaccctgtcctgcattttcccataactttcacttggcagaaaaggctccacccaatatgttctcaacttttaagtcaggagattgagaccatcctggctaacacggtgaaaccccatctctactaaaaatacaaaacattagccaggcgtggtggagggcgcctgtagtcccagctacttgggaggctgaggtaggagaatggcgtgaacccaggaggcagagcttgtggtgagcagatcgcgccactgcactccagcctgggtgacagagcaagactccgtctcaaaaaaaaaaaaaaaaagaaaagaaatacaattctttatacttctaacgtctagtatacttcattctagattcaataccccagaaaaacgttttcacaatatatagcattaggtaaatacttccacttatttgtttctaaaatctgtctgccaacacttagctatcttaaaaaggaaagctctgttctaatgaaggggaacatgtgaatgttccttcaaacgatgactctggaacaagagcatgttaccgccattctttacagagctaaatggttcaggctgcagaattctaaggtgaagaagtcatcctacttgatcctctaccacagaagatgggagtccaggtttccaaggccaactccagtatttaacaagagacaaacataatttgtacgatggaaagttctggcctagcctctgacacagactacaaaatgaaatacacaggaagagacagacctgacaacatgaacacacagcctcttggtaacttaagtttccctatttataagaaaataagactagaacgcttcttggggaagttgaagaactggtgagatacagttaaatccacagaaactcttttctccccccaagacagagtcttgctctgtcacccagagtgggagtgcgatggcgcgacctcggttcactgcaacctttgcctgccgagttcaagcaattctcttgcctcaagcctcccaagtagctgggattataggcgcccgccaccgcgcccagctaattttttttttttttttaagagtctcactctgtcacccaggctggagtgcagtggtgcgatctcggctcactgcaatctccgcctcccgggttctaacttttctgcctcagcctcctgagtggctgggactacaggtgcacgccaccacgcccggttaattttttgtattttttttttttagtagacgtggggtttcaccgtgttgcccaggctggtctcaaactcctgagctcaggcaatccacctgcctcggccttccaaagtgctaggattacaaacgtgagccaccacgccctaatttttgtatttttagtaaagacgtggtttcaccatgtcggccaggctggtctcaactcctgacctcattattcacctgcctcggcctctcaaagtgctgggattacaggtgtgagccaccatgcccagcccagaaacttttcaaaagatctctttcttaaattcaaaataactttttaaatcaatttcaaaagaagagtgttttaattcctcacaatctgagacattcaacgagatccaatgctgtcaatgagagcctagccttatacactagtgggaaaaaaaaaatggccttgtctgaaacacttttcacttgtcaatggttattttaactcagttaaaagtacaaaggtagtttgaaagaaggtttcagtgctaattcctaacctatttctaggcaaagtcaccaatgattaacacttttttttttttttttgagacagtcttgctctgtcgcccaggctggagtgcagtggcgcaatctgggctcactgcaacctccacctcccgggtttgagcgattcccctccctcaacctccagagtagctgggataacaggtgcatgccaccacacccggctaattttttatttttagtagagacagggtttcaccatgttggtcaggccagtcttgaactcctgacctcgtgatccgcccacctcggcctcccaaagtgctgggattacaggcgtgagccactgcatggccacattttatttttcaaaggagtcaaaggtttcttggccgggcatggtagctcaggactgtaatcctagcaattttgggaccccaaggtaggaggatccctcgagctcagagaccagcctgtacaacatagtagagacctcatctctataaaaaaatgtttttaattaaaaagatttaaaggccaggcgcggtggcttatgcctgtaatcccagcattttggtatgccaaggcgggcggatcacgaggtcagaagttcgagatcaacctggccaacacggtgaaaccccatcaccactaaaaataaaaaagacatcagccatgcgtgttggcgagcacctgcaaccccagctactcggctgaggcaggagaatttcttgaacccgagaggcggaggttgcagtaagcagagatcgcaccactgaactccagcctgggcgacagagtgagactccatctcaaaaaaataaaataaggttaaaaaaaaaaaaaaaaaaggagtcgacgtttcctaagtttctcctgggccatatattcattccactcatctccaggttgggaaacatggaggcaccaagagggcccctgactggagagatgatggaaccaccagagaacagccttgcaaataagtgctaggttctcctggagacccatttgtttgtgtgtgtgagacagtctcattctgtcgcccagggtggagtccagtgacgccacctaggctcactatgttgtccaggctggtcttgaactcctgacctcaggtgatccacccacctgggcttcccaaagtgctgggattacaggtgtgagtcaccgcgccgggcctggagacctattctagacaacacctggcaaaactgcagagactgtcacaatgctacagtatgaacattactcttcacccaatactgctaagcttcccccagaaatcccaaatcttccttaatattaaccaaaatgctcctgtccaatggtcagttagtttttttcccatcacatttacttttgggaagaaacttctcacaacttaacgagggactggttttctgatttgtcactgatattttttacgttaaggaggagtgtgtgacaattttttttttttttttgagacgcagtctcgctctatagcccaggctggagtgccatggagggatctcagctcactgtaacctccacctcccgcgttcaagcaattctcctgcctcagcctcccaagtatctgggattacagtgcgccatgacgcccggctaattttttgtatttttagtagagacaagattttgccatgttggccaggatggtctcgaactcctgaccccaggtgatccacccgcctcggcctcccaaagtgctgacatcacaggcgtgagccactgcgccgggccgacaatttcaatttcaggtaaaaagtgaaatcaacatcatttacaacattccttttaaagaggaattgtcaagttgtccttccaagtaaggagcaaagccggcaagttactgtgttttcattttcccaggtcttctggtggggagggagctctgtaacgtccccgtctgcagagctgctctccttagtgactcatgacaaggcacttgctgggaagcgggagagcaggaggagagaatcagagggagattaggataagaggtgtccctggctctgagaggggcaggactggctgggagtccctggaattagaccaggaagtctcctggagccgggaaacgggtggggaaggagggcggtttctcttcgccacagtccattctccctgcttagaaaggctcggcctttccctgcccagggcggggaaccggggtcgtaagtcccctggggagggacacggacgggaagcagccgaggggggtgaaagtccccgagaggggcccagccactacagagaaagccctggcgagagaagagaaaggggccgagtcgcggcgccggcaggcccgcctcccccacaggccgaggccggcaaatctgctgcctcatcccggcgtccccgctcccgcccggccgccgcactcacgatgctctcggccatggcggctgctcctgcctccgggctcgagccccgggccgccgccgcctgccgccccaagggcctcgcagacccggccgcggcctcagccccggccccggcctccctacgccgccgccaccgccgctccagcttcgcccgcccggctccgccagccgccgacgtcccggtgcctcgctcaatacgctcccctcgggcgcgaggccgggaaaccaggttccggccccaccaacggctcgacgcatgcgcagggcggcgccgctgacccgcccccgccatccctgcaactggaggaggggattttggaaagttgcgtctgagattacttctgctcgtcctcggaaacccaagcggcacaggaaagtccaaaaaggaagcaaagacgagcatccgaagtctcacccaaaaataactactgctgcgtattatagcgtattataattggggaaacagcattccaaacttctctccatgcacaggtaagtagagaaacaatttcaggaaggcaggatcacaccttcatgtttttttttttaagtattttttaaatttaacataagaaaaacaaacgagtttaaactgcatttcaggccgggcgcggtggctcatacctgtaatcccagcattttgggaagccaaggtggacggatcacctgaggtcaaaagttcgagaccagcctggccaaaatggtgaaaccccgtctctactcaaaatacaaaattaggccatacgcggtggctcacgcctgtaatcccagcactttgggaggccgaggcaggtggatcacctgaggtcaggagttcaagaccagcctgaccaacgtggtgaaaccccgtctctactaaaaatacaaaaattaactgggcgtggtggcgggcacctgtaatcccagctactcgggagtctgaggccggagaatctcttgaagcgaagaggcggaggttagaatgaactgagttggtgccactgcactccagtctgggcgacagagtgagacttcatctcaaaaaaaaaaaaaaaagacgtcacttcacagattctaaggatttttggagttggataccaggaaaccggaagactaaatgtatacatatttcacaacatcacaattactgtgacagtttttttaaactatgttaaattacattaattgattaaattatgttagtaattgtattagtttgctcagggtgccactgtaactacccaacatattgtccctgcccactgcctagactttatcaagacaggggaattgcaataaagagtttaattcacacagagccagcttgtacaggttactgaggttttattactactcaaaaaaaattagtgtccttgagaattcagggatcagagttttttgttttttgtttttttttgtttttgagtccgaatctcactctgtcacccacactggagtgcagtggcgcgatctcggctcactgcaaccttcacctcctgggttccagtgattctcctgcctcagcctcccgggtagctgggactacaggcgcacactaccatgcctggctaattttgtatttttcgtagagacggagtttctccatgttggtcaggctggtcttgaactcctgacctcaggtgatccgcccacctgggcctccccaaagtgctgggactatagacgtgagccaccgtgcccggctggggatccgcggttttaaggataatttggtgggtatggggtcagaaagtagggagtgttgattggttgggtcagaggtgaaatgatagggagtcaaaactgtcctcttgtgctgagtcggttcctgggtgggggccacaagatatgagccagtttatcaatctgggtggtgccagctgatccatggagtgcagagtctgcaaaatatctcaagcgctgatctgttttttaatagtgatgttatcctgagaagcaatttgggaggtttagaatcttgtagcctccagctacatgactcctaaaccataatttctaatcttatggctaatttgttagtcctgaaaaggcagtcttgtccccaggtaggaagggagtttgttttgcaaagggctgttaccatctttgtttcaaagctaaactataaactaagcgcctcccgaagttatttcagcctacacccaggaatgaacaaggacagcttggaggttagaagcaagatgggttcagttaagtccgatctctttaactgtaataattatctcagttataagaaaatataacataacaaaatctctcacagactgggtggtggtttggaattacttttctttttttttttttttttttttgagtcggatctccctctgtcgcccaggttggagtgcaatggcgcgatcccagctcactgcaacctccgcctcgtgggttcaagcgattctcctgcctcagcctcctgagtagctgagattacaagcgtgcgctaccacgcccggctaatttttatatctttagtagagacagggtttcaccatgttggtaaggctggtctcgatctcctgacctcgtgatccacccgcctcagcctcccaaagtgctgggattataggcatgagccaccatgcccggcctggaattacttcctaacagtcctggaagctagaatcccagatcaaggtgtcagtagacgtggtttctcctttgttttcttcttttttttttcttttaaggctggggtcttggccgggcgcggtggctcacgcctgtcatcccagcgcggtggctcacgcctgtcatcccagcacggtggctcatgcctgtcatcccagcgcggtggctcacgcctgtcatcccagcactttgagaggccgaggcaggtggatcacgaagtcaggagatcgagaccatcctggctaatatggtgaaaccctgtctctattaaaaataaaaaaaaaattagccgggcgtggtggcgggtgcctgtagtcccagctactcgggaggctgaggcaggagaatggcgtgaacccgggaggcagagcttgcagtgagccgagatcacgccactgcgctccagcctgggcgacagagcaagactccgtctcaaaaaaaaaaaaaaaagaaaagactggggtctcactcccatcgccgaggctggagtgcagtggcacaatcgtggctcactgtagcctcgacttcccaggctcaggtgatactcccacctcagcctcctcagtagctgggaccacaagtgctcacaatcacacctggctaactttttgtatttttagtagagatgggatcttgctatgttgcccaggctggtctctaactactactaggttcaatcaatccacccacctcagcctcccaaagtgcttagattacaggcataagccgctgtacccagccaggtttcttcttatacctctctccttagctcgaagatggcaccttctccccgagacctcacatgttttttcttctgtgcacacattcctcgtgtctctccatgtgtcccaccgtgtgtcccaattttcttgtaaggatgttggattagggcccacgctaatggcacttatttatttatttagggatggagtcttgctctgtcaccaggctggagtgcagcggcaccatctcggctcactgcaacctctgcctcctgggtcccagcaattcccctgcctcagcctcccatgtagctgggattacaggcatgcgccacgatgcccagctaattttttgtacttttagtagagacagggtcacaccatgttggccaggctggtctcaatctcctgacctcatgatccacctgcctcggcctccctaagtgctggaattacaggtgtgagctaccgcgcccagcccctaatggcctttaaaggccctgtctccaagtcccattctgaggtccggggggctagaactttatcataagaatgtaaggggcacaattcagccataacagtggtagatgatgatcgtttcattaaaagattacccagactttggccgggcgtggtggctcacgcctgtaatcccagcactttgggaggaggaggcgggcagatcacttgaggtcaggaggtcgagaccagactggccaacatggtgaaaccccatctctactaaaaatacaaaatcagtcaggtgtggcgcctgcaatcctagttactcaggaggccaaggcaggagcatcgcttgaacccaggaggcagaggttgcggtgagtcaaaatcgtgccactgcattccagcctcagcaacagagcgagactcttgtctcaaaaaaaaaaaggttacccatccttagaacagactgagttggaggccgtggacagtccctgtgaccgtgaccctggctgtggagctgctgcagggcccatgaggttgggtttgtcacctttggggaggtgaagggaagctggagcccagaagctcagcctgcagctctggtcctcgccccgacttcccacctgcagcatatcccacttctccgaggaagatctgaagactcagagtggccttcaaggcctcacctgatccagccctgtcacctcatggacctccctcccacccccatctccgcttgccccacacagccaggtgacctttcctcctaaaacttgcccggtgtgctcccacccaggcgtctcacgcgcgcctgaaaccctctgcctgctccatcagtacattgcctgctgtgctgcaccacccagaccacctctttggactgctgagtgttggtggctgagtccgggcacagtggctccagcctgtaatcccagcactttggaaggccaaggcaggagaatcacttgagtccaggggttcaagaccagcctgggcagcacagcagaaccctgtctctacaaaaaaaattcaaaaatgagtgaggcaaggtggcgtacatctgtagtcccgggaggcgaggttgcagtgagccgagattgcgccattgcactccagcctgggcaacaagagcgaaactcagtctcaaaaacaaaaacaaggaggtgatctggtggggggacgctgtttcattcgtgcagtgaacaagccgggggatagattggcgctggggctgcccatgggtctcttgggattggggttgtgaaccaatttaccagggtctgattccctggttgggagctgatggagcggctgctgaccctgcagagctgaagtccgcatggggggctgcagtgagagccacaaggctggcacccaaacatgcctgcctgagtcacacctgcgctgagcttaggggacccacagagccagggctggggagaaatatatctccacaagcagaggcctccttaagctctaaaatgtgattcttcacatgactcaactgtgactccggcatctgggtagggctcgcacctcccccattcccatgcccagggctgcactgttcacagactagcccagggccgcagtcaggaccagcccagcagcccagccacagaggagccagcgaacctctcccggcgcctgtgctgggggctttctgttccagcgtcaaggatggaggagggggagaggagccccttactgtcccaggtgagccatgccaagtggccttgccctgaggttggagatgtccccagccctgaagtcctaagggaagtccctgggctgggttcacacccacccctgcccctggtgccaccccacacctcaatgctgagattgggttgaggggggtggttctaggcagccccctcccccttccccactgcgcagttctctcagccccatgctggcctctggtcaagggatctgccagatctccctgagggccttgggggcaatctttggctcagggtgcaggagggggtgaaggcaaatgtcccttgcagccagcctccaacggcctctggcccccagtggccccagtctggccaaccaggcactgacagcctgtccttttgcttctagtgacttgttgaggtcttgggggtgataaataaccctcctctggggccgggcacagtggctcactcctgtaatcccagcactttgggaggctgaggagggaagattgcgtgagcccaggagttcaagaccagcctgggcaatgtagcgagaccctgtctctacaaaatattatatatatatatatatatatatatatttagatagagtctcgctctgtcaccaggctggagtgcagtggcacaacctcggctcactgcaacctccgcctcctcggttcaagcaattcacatgcctcagcctgctgagtagctgggattacaggcacatgccaccacacccagctaattttttttagtcgagacagggttttaccatgttggctaggatggtctcgatctcctgacctcgtgatccacccgcctcggcctcccaaagtgctgggattacaggcatgagccaccgtgcccggcctacaaaaaataattttaaaaaattaccgggacggccgggcgcggtggctcacgcctgtaatcccagcactttgggaggccgaggcgggcggatcacgaggttaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaattaccaggacatggttgcagtgcctgtagtcccagctactcaggaggctgaggaggaaggatggcttgagcccaggagtttgaggctgcagtgagctgagagcctgatgctgtgatcagcttcttcctggtgaaactggattggaatgggatccttgcccagcacacagccatggctgctttttattatttatttagtttttgagatggagtctcgctctgtcacccaggctggagtgcagtcacgcgatctctgctcatgcaacctctgcctcctgctcatgcaacctccacctcctgggttcaagcgattctcctgcctcagcctcccaagtagctgggattacaggtgtgtgccaccacgcccggctaattttttttttttttttttttttagtagagatgaggtttctccacgttgctcaggctggtctcgaattcccgacctcaggtgatccacccacctcagcctcccaaagtgctgggatgacaggcgtgagccacaacgtccagcccggccatagcttcttattctcctttttaaaaaaactcttcccggcagaactgggcacctgcggggctgcctcttcccccacagagagagaccagcaagcctttcctgccagtgggccagggggtcccctctgaaggccctgcagcctccaggcggtcttcctgggctcttgggcaccctcctccctgtcctgggagcctgttgggcagggcactgtcctgtcctcggcagcagggtccagtgccgtgtccacactcagtgcgggccgttggtggggccgaagaatgggtgctgggatgtgaggactggtttcagaggggaaagaaaagggcagccatgtgggccagcccctgtggctggtgaggaagcccctctacacaagttccatgctgcaggcacacacagactgatccacgcagatgctgtttcaaactctggggacgcagccccgcctgtgtgctgcgggaaagccagggcgaccctgacccggggaggccgcagacacccacgcataggaccaggagggagtgggtgtgttcactgagcaccgccctgcttggtcttcaccacagcctttcagagtctgctcatcaccctgttctaaaggtggggtcccaccagagctgggaccctcactgccccttctgctgctcagccgagcgggacggccctgagggccccctgcccctggctgtccgcatctctgagctccagtgctgccctccgccatccggcatcctcccatccctcgaaggctctgccaccatgctcttccctgacccctcaccagttgtcacagagtctgggtgaatgcggtctcaccctgttcctcttccctctgcaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctacctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtgagtcttggagtgggcgagggacagggccaccacagggtcgcagaggccacacacccttgtgcgtgtacacacagtcactcacacgtacatactcattcgtgcatgcccacatgcatgcacacgtatacccacatgtacacgcatatccacactggcacgtctcgtgctcacaggtttcacgtgtgtggacacacacctacacactcctctacactgacatgaacatgttcttgtgcacacacaaaacagcctcacactcaggcacacactcacactcaaacatgttcatacacacacgtgtcatgcacacaaggtataggggtgcttgcctctccttgttctatgggctcagggccccaatcagccctgcggcccccagaacgtgcagggtgactctgttccccccgccagggccaggaggactacccaggagcttagttgagaagctgagcccacaaacttagaaagtcatttttctgctgggcacgatggctcacacctgtaatcccagcactttgggaggctgaggtaggcggatcacctgaagtcaggagttcaagaccagcctggccaacatggtgaaaccccatctctactaaaaatacaaaaattagccaggcatggtggcaggcacctgtaatcccagctactcaggaggccgaggcaggagaatgacttgaatccaggaggtggaggttgcagccaaaacagcaccactgcattccagcatgggcaacagagcgagcatccatctcaaagaaaaaaggccgggcgcggtagctcacgcctgtaatcctagcactttgggaggccgaggcgggcggatcacgaggtcaggagatcaagaccattctggctaacacgatgaaaccccgtctctactaaaaaatagaaaaaattagctgggtgtggtggcgggcgcctatagtcccagctactcaggaggctgaggcaggagaatggcgtgaacccaggaggcggagcttgcagtgagccgagatcgccccactgcactccagcctgggcgatggagggagactctgtctcaaaaaaaaaaaagaaaagaaaatgacttttaggtgaattcaggacattattctggaatctgactccacagtttccctccaccgtgagtgtcattaaacgccgtgcatttaggatccagtgcaggattttcttatattctgctcaagggtagctgtctttttgttggtttgtttgtttgtttttttgagacggagtctccctctcgcccaggctggagtgcagtggctcgatctcggctcactgtaaagagggtagctgtctgttttatcagctatccccagtgcatgcacaccccaagcagcacctactctccatgccacacccaggacagacgatatgcactctgtctcccaagccttcttggtgcatgtatccaggagcagctgaacacaagagatgaagtcataggcaaccctgaaaactggccattgggacccagcagtggctaacaggcgggtccttccagactctgcaaagcaccacataggttggtttttggccacgtgtgactgggttggtggcagtccccctagagtgtcgtgatgccacgtctgctgctggcctcgtccccatcccctgcctaagtggggcatactcttctagagtggagagggcatggggatgagcctgcaggtctgctgggcccgtgtgcagagccccagacatcagtggatgcctagggcacctggggactgcctgacctgggctgtgatgagatcaacactccctagctaccctgggagctcctcccccacccctgctttctgtcactgccaggtactgcctctcaagcccttgctcttcccagtaagacctgtggaccattccagaagcctctgccagagttccatccaccctcccctgctccaactctaccttctcaatgagctcagcagcctctgcggagggaggtcctcttatcaatgcttgtctgttcccccttcaaccgtctcactaaatatcctcctgctagtcaacacagccaccacccctacctgcaagcgcagaggactgccgtgcacagggatacgttatagagagccaggtgctgtgtgtgtccgtgtgtgcaggtgtgtgcgaataggagggcgtatgcacgtgtgtgcatgtgcctgtgtggccatggaagggtgaaggtgggtaggcgacattcgcctctgtgcctggtcccagaagagcgggccctccccgccagaactgacgattccatgcgccttgcaggtactttaactaactgcagctcccccggggtgcaggcctgcagccttcccgcctcctgctgcatcgacccccgcgaagatggagcctctgtcaacgaccagtgcggcttcggggtcctgcgcctggatgcggacgcagctcagagagtggtgtacctggagggctgcggcccgccgctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctgagcgcacgccccgaggtccgagaccgccacgcacagggatacagggggcgcctccgcccggctaaaaagcgcggcctgcgccgccgccgccgcctgatttcgctcgggcttcgggtgacttcgccgcaggacctacccagctcgctcacttcgctcgctccgcgtcccccatgccagcccccaacgcagggcgcccggcgaagccacgggactggcgggaggagcacgcggggccggaggaaatcctgaagctgaccctcacctccgagcccccactcccaccccagccgcacagttcccacctcctggcacctccctcccctggggccgccaccccttctgggctcgtgatggtggagctaaggtccaggcctctccctcccgagtgcatttttggggagatagtaaatgttttattcgggtgtatcattcatacagtaaagacaccaatcttcagaggcagcgtagggaattcttacccatcgaagaccgtgaaccaccgcaggtccgatcggggagttccagcccctggcggcgcgctcaaccccaagtcagccctgcactgactacattgccagggccagcggggcctgtttcgggctttcacataagcggaatcccagagggtctgtggggagtcagatctggcccttgctgcgaatggactggtccatgtgaacagggggctactgtgagggcccctgctgctgggccagcttgcagagctcttgcttcccctggatgtggtgtcaggagtgggatcttggttacaaatgggcatgtttgtttttgttgttttcttttgagacagggtctcgctctgtcacccaggctgaagtgcagtggcagggtctcagctcactgcagcctccgcctccctagctcaagcaatctcccaccttagcctcctgagtagctggaactacaggggcccgccaccacgcccagacaattttttgtattttttttatttttattttttgagatggagtttcgctcttgttgcccaggctggagggcaatggcacgatcttggctcaccacaacctctgcctcccaggttcaagtgattgtcctgccttagcgtcccaagtagctgggattacaggcatgggccaccatgcctggctaatttgtatttttagtagagacagagtttctccatgttggtcaggctggtctcgaactcctgagctcaaatgatctgtccactttggcctcccaaagtgctgggattacaggtgtgagccacggtgcccagcctcattattgttattttctttttttttgtttgtttgtttgttttattttttgagacggagtctcgctctgtcacccaggctggagtgcaggggcacgatctcggctcactgcaaactccgtctcctgggttcacgccattctcctgcctcagcttcccaagtagctgggactacaggcgcctgccgccacgcctggctatttttttttttttttttttttgtatttttagtagagacggggtttcaccgcgttatccaggatggtctcgatctcctgacctcgtgatctgcctgcctcagcctcccaaagtgctgggattataggcgtgagccaccgcacccagcctattgttattttcaaatacagacagggtcttgctatgttgcccaggctggtcttgaactcctggactgcagtgatcctcccgccttggcctcctaaagtgctgagattataggcatgagccactgtgcccagatacagccagttttagtgggcactgtctaaggacgagctggctgggtgctctgggggagttgctagtgtcactgtgcctcagtttctctcttgtgaggtgggagtaggagctccggcctcacggcgtgtggtgtaagccatgtccagtctcaccttctctgtgtggcctgttccagccacctgcatgcttcattgactatggcccctgggtgtgcaccaaggccttctgccttgacccagccatggcctgacattgcgtgtcttggggccaccagcaaggctcagtgagagtgtgagcccaagggctgtcttcccactcaggcaggccagcccctcctgccccactgcccaccccttcccccatgtgctccggctcaagtgaccccaccacaggccctgtcccatgcacaaatatgccacagacaggcaaggacacactaattttattttgaaatagggactgcaagggcaggctgtattgagaaggatggccccctggtgtgatgagcttggggcctcatctgctcaccgtgcacgccctggagtcctgctacccagcatgtccaaactaagggcacccccctgggaagggatgcagagacggggagcttctctgtatccccttacaggcaggacagggggctggggtgcagaagcactctggggagacctgccctagctttccagctgggaggaggggacgatctggggtccagcaggctcccgggctggggtccacttcccgttctccctgggagtggagaccgaccaagcctctctgtgggcaggactgaggggtgggcctgtatctccagatgttgagcagggcctggccagcccctgagggggcatcctagagggaggtggtgggctcctggtgactggtattaatatgtagggggagacctgaggttgcagtcccatcctggtgtccaggtgccatctgggctagggaggcatctcctcaacaggaatcctgagcagggtttagagcacagtgggcaggagggggagggtctggacttcagcagggcctcgtgctagatgatgccatattgggccagctcgtgcagctccaggtggttgaaggcctcccaagggcagatgactgtgatgtctgtgggagaaacgggccacggatcagagaggatcccacggcctagggacccccccatcccctgtggccctgtttcccacagcccaggtgtagccctacagtgtgctgagcggggacgtgcggacgctggagtggggccctcctctggggacacactggctgtgggggaaggagggtgggtgcagcaggtccaggggagggaaccagaggagggtggggcttgctgaagggggaggaggcagcgaggggttctgttctttcccaaacccctcccctcacctggtgcaagtgtcccaaatggggacagccccaccctctagatccagtggatctggagctcagtgttgggggaagaagtgatggacaggctgggggtccctaagtgaaaagcaggggaggtgggggccgaggtgggctgcaatgggccccgggcgtgctgggtgtgcctggggggacctgggcagacctcgggttggtactggcagccgtcatacctgttcccaggccttccattccagggatgtcgtccccaaacctgcaaggacagagcactcagggacatggccgggcccagtcctggctcagtcagcctgaggcccgaggtcatctctagccttcctaggagatgaggtgtttggctgggagcccagtgggcagagacccgcctcctccccaacctcccagggcttggcgcatctgaggaggcttccctcacagacccagggtgagtctgctgcccagagcatcatggggctgaggcctagaaaaggaggtgcaagtcccaggatgctgggcaggtgcgtgccctgggggagtacgggggggtgcgtggttggtgcatggtctgagtgtagatttgtgaaggtggcttgtctgtgagtgtgcctcacgtgcatatgtggaggtgtgagcgtgtttgtgcataagagtgtcatgcccgtgtgtgcgcacacgtgtgagtggacactcctcggtgcgttgatgggagcgcggtgcctgtgtgcgcacacgagtgagtggacactcctcggtgcactgatgggagcgagatgcccgtgtgtgcgcatgtgtgagtggacactcctcggtgcattgtgccatggctgtccctgggtggcagtggttgtattttttttatttatttgagacggagtctcactctgtcgcccaggctggagtgcagtggcgtgatctcggctcaccgcaagctctgcctcccgggttcacaccattctcctgcctcagcctcccgagtagctgggactacaggcgcccgccaccacgcccggctaattttttgtattttttagtagagacagggtttcaccttcttagccagaatggtctcgatctcctgacctcgtgatccgcccgcctcggcctcccaaagtgctgggattacaggcatgagccaccgcccccggccgttttgtttttttgagacggagttttgttcttcttgttgcccagcctggagtgcaatggcgcgatctcagctcaccacaacctctgcctcctggattcaagcgattctcctgcctcagcctcctgagtagctgggattacaggcgtgcaccaccacgcctggctaaatttgtatttttagtagagacaggtttctccatgtttgtcaggctggtctcaaactcgcgatcctagggggctactttggcaggtattaaaacttttttttaggccgggcgcgacctcaggtgatctgcccacctcagcctcccaaagcgctgagccaccgcgcctggccggcagtggctgtattttcaagcatggttggcagtagcatctggagcgggtgacaggagcccccaattccccttccccctcctccatccctgctcaggccctcaggcaccgccctaccttccccagctgtgaggctgggaccactcacccagtgaagtggccccaggctctgccccgccctccccttcctgtgcagcctcaggaccgcctcctccctttcagaggccccatcccccagctctgcttacccttgaacgcctttctttgggggcttgctcttgaactgcctggtctgtcgctgcttaaatttagggggccctttcctgggggtgacaggtcccccggccaccctggtggctgaccggaactcagccttgggcggttccaggttcatggtgaggctgacggagacaccgcggcaaccttggctcctggactccctcctgctgcggtctgggggcagaccaggcccgggtcccagtcagccctcctgcttccaacccttgtgggggtctcaacccaccggtggaggggctgagacccagccccgccagctccagcgtcatccagacagcagcccctgcaatccgccctggggtaaccagcctgccagctttgcttgggtccacccgcacgctcccattccccttgcctagtggatgcccccctgcaacgctggccacacacagctccggactcccccctgtcctggcctccctcgccccggcccacaatccacagcaaacctagcctcccaacctgtggcaggtcctgagcctggagtcctcaccacctccctgtgggtgaccactgacaacttcctgccccttcccctgcgttccccaccccagggaagcgtgactcccgtcggcatttaactgctactctgggtttttttttgttttgttttgtttttgagacagagttttgctcttgttgcctgggctggagtgcagtggcactatctcggctcactgcaacctccgcctcccgggttcaagtgattctcctgcctcagcctccccagcagctgggattaccggcgtctgccaccatgcccggctaatctttgcatttttgcatttttagtagagacggggtttcaccatgttgacgaggttgtctcgaactcctgacctcatgatccacccgcctcagcctcccaaagtgctggtattacaggcgtgagccaccgcacccggcccagctgctactctgatgaaagtcctctgtggctcctgctgggaatgggcctgccaggcccagcagaggagcctgcctctgagctgcccttcctgatggttagtgggctgcctccatctcaagttcccgctcagggaggtctcccctgaacccccgccctgcagccactgtgtccttaggttctgatttgccgcttctcatcacgcgtcgagttagccctgattccaggctggtgggcgtctcccgggctgttgccctctgattcttttttttttttttttttgagacagagtcttgctctgtcacccaggttggagtgcagtggcgagatcttggctcactgcaacttctgcctcccgggttcaagtaattctcctgcctcagcctccggagtagctcagattacaggcatgcgccaccacacccagctaatttttctttgtgtttttagtacagatggggtttcaccatcttggtcaggctggtctcaaactcctgaccttgtgatccacccgcctcggcctcccaaagtgcagggattacaggcgtgagccaccgcgcccggcctaaaaaagttttaatacctgccaaagtagccccctaggatcctattccagagctgtggctggaatctcaccttttttttttttttagacggagtctcgctctgttgcccaggctagagtgcagtggcacgatctcagctcactgcaagctccacctcctgggttcacgtcattctcctgcctcagcctccccagtagctgggactacaggcgcccgacaccacgcccggctaatttatttttttttttgtattttttagtagagatggagtttcaccatgttagccaggatggtctcgatctcctgacctcgtgatccacccaccttggcctcccaaagtgctgggattacaggcgtgagccactgcgcccggccaacccctctgattcttattgatgggtttattgctttctgcctcttgtctgtgctttgcagttggggtgctgtcagttcccttcacccactcacggaggcatccctgagcccctcagcaccatgacgggcaccccgcagtgctgatggagaatgacccacaaaatggggggcagggtccccaggcacggcgcccctgggaaaggggcctgtctcagagacttggtgctgagctgtgaagccctgcgttccccaaccccacttcatagagggacaagctggggcttggggacggagggtgccgggcatgtgttccccctgctgggggaatcaccaggccctctctgtgtctggagtcagctcggggagcagggtcacccgcctggcgtggcgtggcgtggctgaagggcctcggccgctctggacgagatcagtgtccctgcactgctgcacagggtggcctctcctcctcctctccctacagcctctccccagatgccctaagccccagtgacctgggccaagggcagttcagcttcccctaagcctattaacagcagaggggaattcctaatctcccatcgagctgctgtcagctgcacatgctgccggaaagttctggaaggaggcacatgacacagacaggaggggctgcttgcccgcactggatgccccagggaccacctcttggggtcccctttcctgcccctggtctttttggctgggattcctgactccagccctgggctactaccagctgtttgccgagcttcaggcgtgagagtgatcagaaagcaagggcaggtggcccattttggggacgcgggctctgcaaggggtgctgggcacctgggattggggtggaccctgccatggcaccttccctcactaaggttcagcctctgtccccgggactgggaccagcaccagcctgtgcaaaaccagcactcaggagcccggtggtcccagctgctcagatcccatggcacccaatcctcatatcctagatagcacaggccccgtccagctgcttctccagccctgggacatgggctgtcctgggcagctctgggccctgatggagctccaaccatcagatgccatccatgtggaaaccgctgcctgcgctgccctggcccgacccagcctgtgactggcgtccactcaggtcagctgagcccacgtggcctgaggttcccagaccatcactggcctggggatggtggaagcactggttaccatgggggagcagaggaggaggttggctgggagtcccctctgaataacagggtggcgggtaggcatctgcagacccagacctcagccacggtggtaaaagcctgtcagctccctctgccccttgggtgatgagcagacccccactgactcactgggggaagtggctgccaggaaagacagcggggttggccactactcaccaagtgcagggcgggtctcagggggctgtgctgtgagtgctgggcctccctccgcagggtgccagccccggcctttatctcgctgcttcatgagctgattaggcgtctcagtgccaccctaatgagattgttgggccccgagggggggcacaaccaccaaggttcaggggatggagaggaggggctcaggtgctgtcaagggctccaaggaaggacacccagcagatggggccgggacagggagagaagtgtgaccctgaacagccaggctcctgcagctgcccatcttccagatggaagcaaccacagtgtctgctgtcttgggcctccctactgcctttcctgaccctgcctgatctctgaagggcccaccttcatggtccccaaaaccctctgcagcctggccctcacccgctgctgtggcctcacatctcacccctcccaccccagggcctttgcacctgctgctcctgaaaccaaacaaggacccccccccgcccttaggggcctgtgggtcttcccaagcacagaagcaaggacaatgttgagttccttcaagggcaagccaggcccccagccagcccagagaaggaaatgagcagccgatccacaggaaggtcacaagaaggtcacaggagcttagaacaacagatggaagccagagtcccgagagtctccacagaagcaaaccatgccatcttagcaggtgctcctcagttgttttccagaaacagggactcccaccaaaggggcgtgctggcacacagacctcacatgagcgggagctgaggactggcctctgaccacccttctcttacctaaatttcttcctgaggggcctggaggaggctatgcccatcctgaggggcctggaggaggccatgcccacaacccagagctaacattctttcctgcggatcccaaagttttagacaaagattcgcttctgcaccaaatcagaaaacctttgaatccacctatgacccgtggtccctggcttcaagatctccttgctatttatggcaaaaccagtgtacaacctccatgtactgatttatgacttgcctgtgacctctgcctctgcacctttaaaaacccataactcaggcctggtgtggtggctcatgcctgtaatcccagcactttgggaggctgaggcaggtggatcacaaggtcaggagatcgagaccatccttgctaacatggtgaaaccccgactctactaaaaatacaaaaaaattagccgggcgtggtggcatgtacctgtaatcccagctacttgggaggctgaggcaggagaatggcgtgaacccgggaggcggagcttgcagtgagccgagatcgcgccaccgcactagagcctgggcgacagagcgagattctgtttcaaatgaataaataaataaataaataaataaataaaaacccataactcggccgggagcagtggctctcaaacagcgctttgggaggctgaggcaggaggatcacttgaggccaggagttcaagaccagcctggacaacatagtgagacccccccatctctacaaaaaatagaaaaaattagctaggtgcagtggctcacttcttattttattatttcatttttgagactgagtctcgctctgttgcccaggctggagtgcagtggcctgatctcggctcactgcaacctctgcctcctgagttcaagtgattctcctgcctcggcctcctgagtagctgggattacaggctcccaccaccacgcccagctaatttttaatatttttagtagagacagggtttcaccatgttagccaggatggtctcaatctcctgacctcgtgatctgcccactttggcctcccgaagtgctgggattacaggtgtgagccaccgtgcctggccacagtggctcacttctatagacccagctacttgggaggctgaggcaggaggatcccttgagcctaggagctcgaggctgcagtgagccatggtcaaaccactccagcctgggggacagagagagaccctatctctgaagaaatatgaaaattttgaaaaattaaaaataaaacctggacgggcatggtggctcacgcctgtaatctcagcactttgggaggccgaggcaggtggattacttgagatcaggagttcaagaccagcctggccaacatggtgaaaccctgtctctactaaaaatacaaaaattagctgggcgtggtggcatgcacctgtagtcccagttactcaggaggctgaggcaggagaatcgcttgaacccaggaggtggaggttgcagtgagctgagattgcaccactgcactccagcctgggcaacagtgagactctgtctcaaaaaataataataaaaatataaatagtaaaataaaataaaatgtatgagtactccttttttggtatcatgtatcacagacaatatacaaagacaatcacatgaaaatacataaagctccaaatagacctaaacaaagaccctatagccttgattgtaaaactctagccatgagactggcaaaaatcactagtccagaaaggacggctggattcaagttatgctgcaataaatggaacaagtcaaaaacctcttgtcccacatggctcaatccctcactcagccccagaggaaacaagattgcaatccatatcttttttttttttttttttttttgagagacaggatctggctctgtcacctaggctggaatgcagaagtgaaatatcggtggctgcaggaattcaaggctgcagagagctattattgtaccattgcactttaacctgggtgacagagcgagacctcaactctgaaatagtaaaataggccaggcatggtggctcatccctgtacttttggaggacgaggtggctggaccacctgaggtcaggagtttgagaccggcctgggcaatatagtgaaaccccatctctactaaaactaaaaaaattagtggggcgtggtggcgggcgcctgtagtcccagctgccagggaggctgcggcaggagaatcatttaaacccgggaggcggaggttgcagtgagctgagatggcgccactgcactccaacctgggcgacagaggaagacttcatctcaaaaataaataaataataaaaaagaaattaaacggtgatgtggaacactctttaaattgtcgttcaccacattttcatatcttcacaataatgcaaaacacagtcacttgcagaaccggttctgatgacttaaataccaggtacaattttagccctctacgtaattgcttggaagttacttatgtttacatgaaatgaaactattaggccgggcacattggctcacgtctgtaatcccagaactttgggaggccaaggtgggcggatcacctgaggtcaggagttggagaccagcctgaccaacatggagaagacctgtctctacaaaaatacaaaattagccgggcgtggtggtgcatgcttgtaatcccagctactcaggaggctgaggcaggagaatcgattgaacccagcaggcagaggttgcagtgagccaagatcgtgccattgcacttcagcctgggcaacaagagcgaaacttcatctcaaaaaaagaaaagaaaaaaagaaaagaaacaaaatgagactattaggctgggcacggtggctcacacctgtaatccagcactttgggaggctgaggcaggtggatcagctgaggccaggtgttcgacaccagcttggccaacatggcgaaaccctgtctctactaaaaatacaaaaaattagccaggcgtggtggcaggtgccttaatcctagctactggggaggctgaggcaggagaattttttgaactcggtaagtggaggttgcagtgagcagagattgtgccattgctctctagcctgggcgacagagactctgtctcaaaacaaaaaaatgaagctattaatacttttctacagcagtaactacacacaggaagaccaagacaagcacaagttaaggaatggagctttcccaaagcggctgtgtataaagactataaactgttttttgtttgttttttgagaacaaacaaactcactgcagccttgacctcctcaggctcaagcaatcctgccacatcagcctcctgagtagctgggactacaggtgctcaccaccacacccggctaatttttgtattttttgtaaagatagagtctcactatgttgcccagggtggtctcaaactcctagactcaagtgatccgcccgtctcagactcccacagtgctaggattacaggcgtgagctgccgtgcccggccggacatacgtagttttttgccatggcttttcttgtgttctctatctacaggctaagcagattctgtgtgctgccctggggtctttaattacttcaagtgctcatgttgaactatgaatatgattgtgtgtgtgattgttttgtttttagagacaggggtctctgccacccaggctggagtgtagtgaggcaatcatgacttacttccgtcttgacttcctggcccaagtgatcctcctgcctcagcctcccaagtaggtgggattacaggcacacaccaccatgcccagctaagtttttaaaaattgttttgtaggctgggcatggtagctcatacctgtaatcacagcactttggaggccaaggcaggagcccaggagtttacgaccaacttgggcaacgtaggaagacccccatctccacatacagacacagacaaaaaacaatgaaccgggcatggtggcacttgcctgtagtcccagctacttggtaggctaagatgggaagatcacttcagccttggcggttgaggctgcagtgagctatgcctgatggtggcaggaggcagtcgaatgcctaggcagatacgggcaggtccccagtgaaaccccaccttcaagccaaagacaaaaagcctgaaagccagccaggcacagtggctcatgcctgtaatcccagcactttggaaggcagaggtgggtggatcacctgaggtcaggagttcgggaccagcctggccaatatggtgaaaccccgtctctactaaaaatacgaaaattagccaggcatgccgggtgcagtggctcacgcctgtaatcccagcactttgggaggctgaggcgggtgaatcacaaggtcaggagttcaagaccaaccctggccaagatggtgaaagcccgttgctactgaaactacaaaaattagccatgcgtggtggtgggtgcctgtaatcccagctacttgggagactgaggcaggagaatcgcttgaacctgggcggcagaggttgcagtgagcccgagattgcgccactgcactccagcctgcgacagagtgagactctgtctcaaaaaaaaaaaaaaaaaaaaaaatcagccgggcatggtggcaggtgcctgtaatcctaggtactcgggaggttgaggcaggagaatcacttaatcccgggaggcagaggttgcagtgagccaagatcgcaccactacactccaacctgggtgacagggcgagactctgtctcaaaaaaaagaaaatctttaaatctacctatgacctggaagccccctcccttcaagttgtccctcctttcctgaccaaaccaatgtacatatgataggtattgattgatgtattatgtctccctaaaaagtataaaagcaacatgtgtccacgttgggcacatgttgccaggacctcctgaggctgtcacaggcatgtcgtcaaccttcgcaaaataacctttccaaacttattgaccactaaagaactcatccctgtaaccaaaacctgcctgttccccaaaaagtattgaaataaaaaataaataaattggccaggcatggtggctcacacctgtaatcctagcacttcaggaggctgaggtgggcagatggcttgaggtcaggagttggagacctgcctgaccaacatggcaaaaccacgtctctactaaaaatataaaaattagccagacgctgtggggcacgcctgtagtcccagctacttgggagactgaggcaggagaatcgcttgaacccgcgaggtggaggttgtggtgagccgagatcgcgccactgcactgcagcctgggccacagagcaaaacttcatctcaaataaatcagtaagtagattcattgaggcctgtctcagatacttttggtttatagctctcactaactaaacaactcatgaaaactaagcagttggccgggcacagtggctcatgcctgcaatcccagcactttacagggccgaggcaagtggattacctgagcctaggagttcaagaccagctgggtgatatggcgaaaccccgtctctagtaaaaatacaaaaaattagctggatgtggtggcacgcgcctgtagtcccagctacttgtgtggctgaggcaggagaatggctttgaacccaggaggcggaggctacagaactaagcagtccgcggacttgctttggggatcctgggtaccaaaaatatggacctgggtctttgggcgacttggtggggagtggcatcccacgagcacaggatgaggaatcttacttcgggaattcttgctgagaaaagtgcgtcggcaaggccgcccagcagagaggaattcattcaccggctcaggttgtcttagataatagggtagctgtagattacatcttaggtgagcagggaggaccacataaggttgcaaatcccacatcctgtacttacacacatgaatctgcaaagattaaaaacccatgtaggtgacattagagaacaggccacttggttatggcaggtttccctgactgccactgagaactgttttctttccttgttttcttagatttcttatggaataatccacattttcaggattgctaaacttaggcatgtcagccttgctaatttttttttttttttaggcggagtctcgctctgtcacccaggctggagtgcagtggcgtgatctcagctcactgcaagctccgcctctcggcttcacgccattcttctgcctcagcctcctgagtagctgggactacaggcgcctgccaccacgcccagctaatttttgtatttttagtagagacagggtttcaccatgttagccaggatggtctcaatctcctgacctcatgatcagcccgccttggcctcccaaagtgctggctttacaggcgtgagccaccgcgcctggccggttttttttttttttctttttgagatagagtcttgctctgtcacccaggctgcagtgtagtggcataatctcagctgactgcaacctctgcctcccaggttcaagcaattctgcctcagcctctcgagtatctgggactacagttgtgtgccaccatgccccactaactttagtatttttttttttgagatggagtcttgcttgctgtcgcccagactggagtgcagtggtgccatctcagctcaccgcaacctccacctctaggttccagcaattctcctgcctcagcctcctgagtaggtgggattataggcacccgccaccgtgcccagctaattactgtaatttcagtagagaaggggtttccccacgtttggccaggctggtctcaaactcctgatctcaggtgatccacccacctaggcctcccaaaatgctgggattacaggcgtgagtcaccacgcctggccacgtcctgctgctcttaccaactcccctgggagctgcggctgaaggagctggaaggactggttccaggtagtgcttgggccactgagggctgatctgcagcccctgccaggctggtggaagggcacccgaggacccctgccagggattgatggcagctggacagatgggcacttccaggctgcctgtgggcttctgtgcctgccaaaggctttgccacagtgactcaatgagatcagatggccttccctctgctgcacgctgagagcaaccagagcaggcctttgccaggacttgggggaaggtgggacctggcctggaaggggcactggggtcactgtcatttgactgttcaacgaaaaggggtcctatttattgagtcagagtttcactctcgtcacctaggctggagtgcagtggcatgacctcagctcactgcaacctctgcctcctgggttcctcagcttcctgagtagctgggattacaggcgcctgccaccacacctggctaatttttgtatttttagtaaagatgggatttcaccatgttggtcaggctggtctccatctcctgacctcatgatctgcccgcctcagcctcccaaagtgctgggattacaggtgtgagccaccacacccggctgggggtcttattttcaccacactcggctgggggtcttattttaccctcatggcagggtgatggctgcaagagctccggaggtgcataatgccgacctggacctgctcgctttgaagatgcaacacaagccttacggacaaccacacaaaagcctcctgttgaggccaaatcagcagccattctggttggcagacatactgccaaaaaaaccacccccaaaacaaaaacctcctgtgaaaccaccatagagaatttatttttttctcaggtgaagtcagtaactaattcttcctattcccgttggacacaaggagtctgtgagggggtgtgaaggaaggaggctgcggctgcgtcctggactccgtcctgcggtagggagtccagcagggatggctcagcctccgcacctggtgtgcagccggatctccatcctgaggaaggccttgaggttctcatcagccacgtgctcctccagggcagccagggcccgctccccaccgtcctggaagtgctgcagcagcctgtccgcgtactccacccacacgcagttggggcagccactcatgcagcagtttgtgggcggctggagctcaggtggcagcgatgccttgggcggcctggtgccgtccgcacctgcttgggagcccacctctacgtggtctgtcccgaattttctgcgcccatcaggggcttgcgctccgggatggtgcctttgaagaaagctgccacctccaggaagcctctggcagcagtccgggctggagaaccggcgagccccctgaggatgcagacaaacatgtgactctccaggaagctggtgaggcccggtctacccccagcagtgaggacatttcagctctcctgtcattgggcaactggctccatgtcctcagctttttcacttcctgtgactttagacatgttatttcacctctctagactcagtttccccactgtgcaatggaagtcatgggtatgacacggtgtgattcacaagaagtgccaggatcagggcctggcgccgggtgtgcactcaagcacatggtggggggtgggggaggcactcgacacctccagctaagatggctgctctgtggacaccagtatgcgagaggtgtaaccctgtaagctcctggccagcccagcacctctaccagtataaccaagccccaccacctctgagggaccaaccggaagaatcgcaccaccctttatccaagtttccctgtcacaaagcccaggcctctcaggcccctctcatcccagcgtgaatgtcctataggcagtcttccgtcgctgccctgctctatctacccaggatcacggactgacacgctaccaacttcacttatttaactagtcctgcgaggggcatcatccgctccatgtccacggccagtccccagagcccaggagggctcgcacacaggcgctcggcagatactgagaaacaggaaagtggccgttcaccgggctgcttcctctcccaaggctaagcggcccctccacagattccggggcggggactcggtaagagccgatggaggagaggagcgaggggtccttcggcggcggccagcgcgcgatcctcccggctccgtccccacatgcgggtggaggggccggggctcctcccggtacgtgcgggcccccggacagcggcctctcggacgtgcccttcggcgctgccaagacccgtcctggtacttgccgagccacggaccgcggcggctaccgcccggcctccctcgaccaccctccgcagcagcatcgcccgcggacgggatccggcaacccctgaccgtgagcggcgggcgctccggccaatcccggaccttcaggaagtcgcgccgctccagccagcgtgaggctgagcgcaggaagcggaagtgccgatcggtggggcggaaccatgcaggaaggcggaagtggcttcgctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcaggtgactgcgctgccccgcgaggccgccacacttccccagagaaggggacgccttgaaggctccgcccgggaccccctagggagcgttcgctcggaccccttccccaggtcgggctcagtgccctcctctgtctgtgcccgcggcccacgctccgccaggatcggttgaatgaatggaggcgcgagcgagtccttggttttgcctttcccgcgtcccagtgtcccgtctttgtggttctggacgaggtcagggcggaaaggcctcctgggctttcggagtgcctttcggcctcgcgtcccgtgaggaaggggttcagggacagccactgagtgagaccgagaggaaagatccctgctccctggactgctggaccggctcgcaccacagaagccagatgtggcccctgtatagatagattctttttttttttttttttttgagacggagtctcactctgtcgcccaggctggagtgtggagtgcagtggcgcgatctcggctcactgcaagctccgcctcccgggttcacgccattctcctgcctcagcctcccgagtagctgggactacaggcgcccgccaccacgcccggcaaattttttgtatttttagtagagacggggtttcactgtgttagtcaggatggtctcgatctcctgacctcgtgatccgcccatctcggcctcccaaagtgcagggattacaggcgtgagccaccaagcccggccagcccgtgtagattctattgccagacccaactattgtttctcttactgattctgcttgtgctttacttgggacgggtctcacccccgtgttctttctcccagcaaagagaagaagaaagtgaactgcaagcccaagaaccaggacgaacaggagattcctttccggctccgggagattatgaggagccgccaagagatgaaaaacccgatcagtaacaagaagaggaagaaagcaggtgtgtgcaggcccatactgggcggcagtgaagctttgtgtgtctcaacccgcccaatcgcccaaatacttcagaacgtttcaggcagaggaaatatgccaagacccggtgctcagaaggtgggggagcgtggccaaagctaaagcagtggctggcagctggtggcgctgtggttccagacgaggcttggaaggaggctgtggggtgggcggggaggacccgttatggggcctcaggatccatgctaaggagcggcgtttttttctccccaaaagtagcgaagattcatcagagtttttagcagggcacggccaattcatgtttactctaagcaaaaaaagggtcaccgagcgatgatggagtgagggagagtggacctggcaactggcggggctactgccagggagaagccatgattcttgggacaagagtgctgaagcaatggtagagagaagtgggtggagtcaggagctgaaggaggaaattccatcaggcccctctgagaagtcttgccttcctcccccaagtctgggtagggtgtccacatgtccaccgctgcaacccagaggtaacactctgggcatgttgggaaacggagtccactgtgtgtatattttgcttatagacacatttctcttcccaaacgtggcactggttttacagcaaagctgttttataatttgtgtataaactgtaggcttcttgttgggggttatatggctgccaaagggatagtgagatagaggtgaggaaggtgcagggaggaggcgcactggcctgggtagcacatggcacgttctgaaccgtgctgcattgaattggcacctttgtttgtttgtttatttatttatttattgagatggagtcttgcttcctcgcccaggctggagtgcagtggcgtgatctgggctcactgcaacctccacctcctgggtttaagcagttctcctgcctcagccgcctgagtagctgggattacaggtaacgcaccaccatacccagctaattttttgtgtgtggtttttttttttttttttgagacagtctccctctagcccaggctagagtgcagtggcacaatctcagctcactgctacctctgcctcccctgtcccagttccagtgcaagcaattctcctgcctcagcctcccgagtagctgagattacaggcacacgccaccaagcccagctaatttttgtattgttagtagagacgaggtttcaccatgttggccaggctggttttgaactcctgacctcaagtgatttccccacctcagcctcccaaagtgctgggattacaggtgtgagccactgtgcctggcctttttttttttggagacagaatatcggctcactgcaacctccaccttccaggttcaagcaagtcttgtgcctcagcccccccagtagctgggattacaggcctgtgccaccatgcccggctcgtttttgtatttttagtaaaggctgggttttgccatgttggccagtctggtttcgaactctggcctcaggtgatccgcccacctcagcctcccaaagtgctgggattacaggtgtgaaccaccatgcctggcaatatgcatgtcttcacatatttatgaacacaaccacctgcctggcactgtccgcctcctgtgttctacactcgcccggggtcctgcgcttgcgttctcagtggatgtcataggtctgcccacgtttcttttttgagatggagtctcgctcagtcgcccaggctggagtgcagtggcgcaatctcggctcactgcaagctccgcctcccgggttcacgccattctcctgcctcagcctcccgagtagttgggactacaggcgcccaccaccatgcccagttaattttttctgtgtttttagtagagacagggtttcaccgtgttagccaggatggtctgaatctcctgaccttgtgatctgcccatcttggcctcccaaagtgctgggattacaggcatgagccaccgcgcccggcaggtctgcccacgtttctctgtgtagctccactgggcttctttcggcagctgtgcaatggagtctgtgggtgatcagaggagaattcattcaaccagccacctaggggtggacattaggttgtttctgctttcctttttcagctgtgctgcagtggacatctgtgacaggtgccattgggctggggggtcacgtccccggggatgccgggccgggcattctacatcctcttcagctgctgtcgttggggtgcttccagccagcctggtcttcccttcctgtggctttgggaggggaaatgagcatgggtcacctgcctgccactgtctgcctcctgcctcctctgaggcctccctttgtcctcagcccaggtgaccttcagaaagacattggagaaggaagcaaagggagaggagcccgacatcgcagtccccaagttcaaacagaggaagggggagtctgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgtgagtggaggcgggagggggaggggtctgccctgggagccggagggaagacattgggttcccatgacggccctctgcaggtaccctgtttcatagccatggggcagcctggattcagggagaccaagccagagccctgggagttggcgagtcggagcatccagctgggagccagtgagggtgtggcctccaggaggctgcggaacctgggaactctgcggagacctcgcttggtccttgctttcacaggaaaagcaccagaaagccctagccctgtgggaatcagccctgagggggtcggtctgagggtgacgtgcccaggggttctgtttccattagaacagaatgtctctcgtccaagagactacaccttcctaattctctaaaagctttggccgagtacagtggctcacgcctgtaatcccagcactttgggaggctgaggcaggtggatcacgaggtcaggagatcgagaccatcctagccaacacggtgaaaccttgtctctaataaaatacaaaaaaaaaaattagccgggcgtggtggtgcatgcctgtaattccagatacttgggagcctgaggcagtggaatcgcttgaatccgggaggcagaggttgcagtgagctgagatcgtgccgctgcactccagcctggtgacagagcgagactccatctcaaaaaaaagaaaaaaaaaaaaaagctttgaaggtttgagaggttgctttcagctctgtagattccctgtttctggattgttgtattacttatagttaccttagccagtgaaagttcatcacagagaacgtggcccagatacagcctggcgccacggtgatctccagagctgtcgctgaaggtgaagcttccagattcacattgagggagacgtgatatacaatgcttgttaggccctttagacacagcagcaccggatgggctggatgagtctctgttgggtggtctttggcagccttcccagccttcgtgcacaaggtgccagtagcccttgcccacgtgtctgcacacattgtcagatgttccctggcaggtagctgtccccagctgagaaccactgggggacctgtgaggggcctgttggggtcagagccttctttggtgggcagctgtgggttttggggtggtaaggggagcggggacttggaggcagccacctgttcttgggtccctgctctgccacaggggatcccttgtgggtggggcggcctctgcctcctccctgggtggaaagagaatttaggaatctgagtgacatgtgctttcttccccaggttccagaagcggcgactagataaagtccgacggaaaaaggaggaaaaggcggcagacaggctggagcaggagttgctccgaggtagctcttcccaaagcgatggtgtcagcagtggtccgggtggggcctgggcgcaggccttctgttccccaccagccctggctgcactgggcacctgtggtttcccctggggtccacagccattagaccactggatgagttggtgttctgtcccagccctatgggagggaggtgggcgggtggtggctctgggtgtcaggggtgcagtggctgtgggcagcagtcctcagttgtattctgctcctccagacacggtgaagtttggtgaggttgtcctgcagcccccagagctgactgccaggccccagaggagcgtaagcaaggaccaggtaagtggggcacggggacaacttgagtttgtcccccagtgctgccagggaacagaagccttggacaggctggacacggtgggtcacacctgtaatcccagcacattgggaggccaaggcaggcggattgcttgagcccaggagttgataccagcctggacaacatagcgagatcctgtgtcaagaaaaaaaaaaaccctcagccaacgtgtgcgctgtctggtgtgtggcctgagagtgcagtgttctcgctggcgggagagctgttgaagctgtgaggctttctgttgcatcccctcctttcccagcctgtgcctcaccctcccctctctccctcagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaaataccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaattggagaatatatatttaaagtcagggctgttttcctcttatgggcatgtttcccaccttgtgatggacctggcggccccagccctcgcgttgggatgttgtttttgcagcagccagaactcagccccagatcacaagcagcagctggaagggggtggcctttccctgggaaagggctgggacggcagcgggtggcactcccactcgctcaatgcctttggttttgggtgtcagatcggcccgtgtatggctaagcaaagggatcccacagggctgggaaagcgctcatgctctccactgcatccatgattctcaggttttagctgctggaagggaaacccctggtggtttttagggcctctttgttgcccaggctggggtgcagtggcataagcacactgcagcaagttgttgggctcaggcaatcctcccacctcagcctcccaagtacttgggacaacaggtgctcaccaacacacccaaataattttttgtgctttttgtatagatggggtttcgccacgttgcgcaggctggtgtcgaacttatggactcaagggatccgcctgctttggcctcccaaagtgctggggttacaggcgtgagccactgtacttggcattttttttttttttctgaggcagggtcttgctgtcaccttggcaggagtgcagtggcacgctggtctccaagtcttgggctcaagattagcctgccttggcttccctcagtgctggggttccaggagagaccagctcacccctcctactttttttttttttgagatggagttttgctttcgttgcccaggctggagtgcaatggcacaatcttggctcaccacaacctctgcctcccaggttcaagcgattctcctgtctcagcctcccaagtagctgggattacaggcatgcactaccatgcctggctaatttggtattttttagtagacacggggtttctccatgttggtcaggctggtctcaaactcttgacctcaggtgagccgcccgcctctgcctcccaaagtgccgtcctgcttttcttacttatcctttacttctggaatcttcaggaggaggtgatgtgggcatgtcagggtcaatgtttaagaggcgaaggccatggatggacctccctgggccttccgctctccatggggcagtgctgttctctccatataaagggaaaactgaatttgcacaaaatcggggtgctgacaaaaccagtgatcccagatgggtcacctacttgtacacacaggtctcgcagcaccctagttgtcaactttcctacaaagaattttcccagactagccagattttctcccagccaacctatcacacatttattgatgtgattttttttgaagaaaaaaattaatgttataatttcacataccgtataatgctatcctttgattagcgtttagtttgatgggaactccaaactgttaaagaaaattcaggccagctgtggtggcaccatgcctgtggtcccagctactcgggacgctgaaatgggaggttcactcaaacctgagaggtcaaggccgccccaccgtctgggaagtgaggagtacctctgcctggccgctgcaccgtctgggcctgtgagctgtgattgtgcctctgcactccagcctgggctgtaacagagcaagacccccatctctaaaacagaaaagaaaaaaaattcctatccaggtgctacatctgcgctgagaagagtccacgagcagagacgactctgagaacagtggtgtcctcagcagcatcaatttccccagactcaggagagaattgggctctggcatgtgcactgaggggggtccagcatgcctggccccatgtgggcggcaagccacccgggtgccaaggcaagagactgaggacacgagctgttccagtataataaaatataagaatagttataccagacatagatcttagatatgattatatatgaatcatgaatcattagtttatagcaattactctttattccaatattataataatcctcgctctataatcataacctaggaaaagctaggccatacagagataggagctgaggggacatagtgagtgaggtgtgaccagaagacaagagtgcgagccttctgttatgcccagacagggccaccagagggctccttggtctagcggtaacgccagcatctgggaagacgcctgttgacaagcggaccgtggtctagcggtagcgttagtgtcaaggaaaaacacccgctacttagcggaccgggaaagagtctccctttccccaggggagtttagagaagactctactcctccacctcctgtggagggcctgacatcagtcaggctcgcccgcagttatccggaggcctaaccgtctccctgtgatgctgtgcttcagtggtcacgctcctagtccgccttcacgttccatcctgtacacctggctctgccgtttagttagcagtagcaaattagtgaaagtactaaaagtctctgataagcagaaataataatgtaagctgtttctctccttctcctctctctctctctgccttggctgccaggcagggaagggccccctgtccagtggacacgtgacccacgtgaccttacctatcattggagacggctcacattccttacactgcccctttgtcttgtatccaataatatcagtgcagcctggcattcggggccgctaccggtctccacaacttggtggtagtggtcccccaggcccagctgtctttcatctctgtcttgtgtctctatttctacactctctcatctctgcacatggggagagacccaccgaccctgtggggctggtccctacaccccagaacagccgctgagtgcagggaccctaaggttgggtgggggtctgggtgacaaggccaggggagtccccagcacccctcacccaccctgcaggacaccccaattgacactgtgtgccagcgaagtggggacctgatggttttgagaacgtgggttattgaaagtggcctgcagcacacggcctgtcaggagcaggcaaggagggtccttatccacccaccccgagaccgtcctcccgtggcaccatgccacgcctgcatagggctccctggctggaacccacccttgaaaaccgcctgaggaggtgccagagtgtggctgccagctccagaccacgtcggctccacctgcctggaacccagctgccaccagcgctggctgggaacacaggcttgctgttttctccgggtattgggaaacgcgtactcttaggactcattcaggatcagcatgtccagcccaaggattgcttcaggaaaggcactccctcccaactaaaggaacgttccgccaagcaagctgacaagcgcggcccacccacctccagccgggtggccacaggcacctcaggctcctacctccttatattttcatgcctcacagcaaaagtcacggtgggtatttcttttctttttttttttctgagacggagtctcgctctgtagcccaggctggagtgcagtggcaccatctcggttcaccgcaagctccacctcccaggttcacgccattctcctgcctcagcctcccgagtagctgggactacaggcgcctgccaccacgcccagctaatgtttttgtatttttagtagagacagggtttcaccgtgttggccaggtctcgatctcctgaactcgtgatctgcctgcctcggcctccaaaagtgctgggattataggcgtgagccaccgtgcccggccgacacttggccatttcaaccaggctttgctaaagtcctctgaaattgggggactgaaacccaattactgggatcacaagttgcctgtgaaatctgcaaggacctgctgtcagggctcattaaaccccaaagtatggcaccttggcatgcagactactctgacccagaggagactggaaggcctcagaagccaggtctttgtccttccctcctggttcctgcctacttttctgccgcaaagtgagtcccagaaaccacaattctttttctcacagcaggtcatagaaactagaactcctctctcccaaagccagccataaaacctagcaaggtcactccctcctccctggaagaccctcattcccgaggggtcctgccctatcctcaggggaaggggaattgtgcacagtggccttgctgggtttccccactgtgtccatcaccagttagacggacgttaggccagagcctgtgtgtccaaccacatttctgcatgcctgttcactcgtcaaacctaaatataagaataaaggttttcacgccgggcacggtgtctcacgcctgtaatctcagcactttgggaggccgaggtgggcgcatcacctgaggtcaagacttcatgaccagcttggccaacatggtgaaaccctgtctgtactaaaaatactaaaattagctgggcgtggtggcacacacatgtaatcccagctactcgggaggctgaggcagcagaatcgcttgaacctgggaggcagaggttacagtgagcaaagattgtgccactacactccagcctgggtgacagatcgagactcccatctcaaaaataaataattaataaaggttttccctgggtctttattgctgaaggctcctgcgtcatgtaaaactttacttatttttttttagatggagtctcaatctgtcacccaggctggagtgcagtgcatgatctcagctcactgcaacctccaccttctgggttgaagcgagtctcctgcctcaacctcccaagtagctgggattacaggcaggcaacaccatgacgggttaatttttgtatttttagtcgagaaggggtttcaccatgttgctcaggctggtctcaaacttctggcctcaagcgatctgcccaccttggccgcccaaagtgttaggattacaggtgtgagcaatcgtgcccggctgtcatgtaaaactaatacatttgctatgcttttaggccgggcatggtggctcatgtctgtaatcccagcattttggggggctgaagcagaaggatcaattgaggcaaggagttcaagaccagcctaggcaacacagcaagaccccgtttctaccaaaaatacaaaaaattagctaggcgtggtggtgcatgcctgtaatcccagctacccaggaggctgaggtgggaggattgactgagcttgggaggttgaggctgcagtgagctgtgatcccaccactgtgctccagtctcggagacagagtgagagcttgcctcaaataattaagtaaatttgttaatgcttttctcttgctcacctgtagtttgttaggtgtgttggctgtcacccttatgggtgaaaaaaggtattgtatctttccgccccatggtactaacaggacagacacctcaggtgtctagtagctgtttggtggtggtaagaggcagggggagcagtgcatggggattcatgtggtgtctaagaaggtggcatccaggccaggcgcagtggggattcatgtggtgtctaagaaggtggcatccaggccaggcgcagtggctcatgcctgtcatcccagcactttgggaggccaaggcaggtgatcacgaggtcaggagttcaagaccagcctggccaagatgatgaaaccatctctactaaaaatacaaaatttagccgggtgcggtggcaggcgcctgtaatcccagctactcaggaggctgaggcaggagaattgcttgaacctgggtggcagaggttgcagtgagtcgccgagattgcaccactacactccagcctgggcgagagtgagactctgtctcaaaaaaaaaaaaaaaaaaggtggcatccaacagggcacaggctgtgtacagttgagagcccatgacacactggaaagcagagactggagcccgagccaccctgaagcacacgccgtgctgcgagcttttcccaggcatcgcacatagccctccacaggaataaagacccatttccccacaagcaaagtgcagcaggtttgtgccacggaggagggtggtgggtgcgaggctccttccatgaccgaaggagcctaggctgccagctgggaaaacatctgtagaaaattcacatctattctcaggactatagggtttcttattcaattgttgtagtcaaatgacggcccctaaaaggtgtgtccaaattataacccctggaacaagcaagagtgaccttgtttggaaaatagggcatttgcagatgtaatgaggaatcatcctggattttcaacgacagatgtccttgtaagagaacacagaggcacaggagagaagctgcgtgaaggtggaggtggaaacaggctttgcaggccacagcccaggggcgccgaggagcaccgcagccactacgcaggcaaggcacggatgctccttcggagcctccagaaggaaactaccctggtgaaagcccagctttggactctggcctccggaactaagagagcaaatttgtgttgttttggcagctgcaggacactgacccgtcaatcaacactcccacaagtggccatggctgagaaccaaagtcaaggaagggcactggggaaccatgggaggcacggccaccatttcctgtgcttcatctgagccccacctggcacacctgtggggcgtttcacggcaatacctgttcactgaacaagtgaaccagtgagaatgctggctcttgtttttttttttttttttgagaccgagttttgctcgtcacccacgctggagtgcaatggcgcgatctcagctcactgcaacctctgccttctaggttcaagcgattctcctgcctcagcctcccgagtagctgggattacaggcataagccaccacgcccagctaattttttgtatttttagtagtgacagggtttcaccatgttggccagtctggtctcgaactcctgatctggtgatctgcctgcctcagcctcccaaagtgctgggattacaggcgtgagccactgcgtccggccaccagcttgtttctaactcgaggcctggctcttactaccacactcacttcacctgcctcatgccgtctgtggcagatgcagggtcagggtaccagcggctcagcaggttggaggttgtgctacagcaagaggccaggtttcagtggcactgtgcagtccatacgccttgggggcagtccagcaggtctccaggaaggaggtgagccaaccccaatagcaccactctaagatacagaacactcggccatctgcaggccctgctcatccagtctggggacaggtttttatttttttatttcttatattttttaagacggagtttcactcttgttgcccaggtgcagtgcaatggcatgatctcgactcactgcaacctccacctcccaggttcaagggattctcctgtctcagcctcccaagtagctgagattacaggcatgcaccagcacacccagctaattttgtatttttagtagagacagggtttctccatgttggtcaggctagtctcgaactcccgacctcaggtgatacacccgcctcggcctctcaaagtgctgggattacaggtgtgagccaccatgcctagcccctggggacacttttttcagaggccagatgtcaacttccatctccacatgcctcagtttacacatcattgcatctcagcacagagccccatcatgtagggttactttgggttattctgcccctgtgagaagaaactattggcagcaaagccatactgccctctgccacctctccccagctcaggccagctgcgcctctgccgtgcagtcaatcgttggctctgtgggtggcctggagccaggccagcacccctgctaagccagtgccttcacgggcgctgatttctgccgtggtgatgttctgcttggcacaagcaatgatgtctggaagcctgattaatgacttcatctcctccgtggacatgtaacagggtaggtcgctggagagaaagaggtgccccatcagagcagtggcagccacacacctgccccggacccccagctgcaccacctccctaccgagccatgcttccggctgtaacccgagggagcccccgcccccgctgtgctccctctcagctcagggacgcgtacattttattgaagagtatcagcaccgatgcttctgcaagttgttctgcagaaaggagacctaagagctgcacacaggatgcagagagctgggtggggtcagaggcgtccatcacaaactggggaaaaagaaaaagacagcagcaatgccccgctgccaaacttcctcccctgggcctcacagacctggcactgggagagcaaaactgcattttttaattaattaatttattttttgagacgaagtctcgctccgagtgcagtggcacgatctcggctcactgaaactccgcctccagggttcagggttcaagtgattctcctgcctcagcctcccaagtaactgggactacagacacccgccaccacgcctggctaattttttgtacttttagtagagacggggtttcaccatgttagtcaggatggtctccatctcctgacctcgtgattcgcccacctcagcttcccaaagtgctgggattacaggagtaagccaccgcgcccggcccaaagtagctttaaacaaagctttgggaacaagcagaagcagagggaatcgagttttatgaagacgacctggtgtcactcgtctctgtcctcatgtggccatcagttctccatactggtatccgcggcacaggccttatcaagatgagaccaaccagaggtacgtataagtccaacataaacacagacgtaccggggagtgacacagagggccaagtctgttctctgcggagcagcagccctgccctcagcaagccctctgtgagctcctaccgggggcctgggagcgcaagcaccagaaaccagacagggtgcccagcaggaagcaacactagctaagacctatttccatgagtagtatagtcactaaataacccaaacccctttctacacacagcaaggttggggactggacgtcacagaaatgtagacacacttccctaaaggaagcccatataggattacaacccaccaggagagaacggcagtttccatagtaactggaccagatggggcccatgcaccccccaagctcccggatggtgatctttctctgtgccacgatgtcagtaagattggtgcccacctataggaaaaaccacgatgcaaaaagaacaatacaaccgctgtcccgttgtgaactcctgaagagcaccgtgcccacaccttacacggtggcctgaaccccgcagacccattctccctaacgcaggaacggcgagcagggaccgacgcccatcagtagctggactcgctgtgggggcgaccagccacaggaagccgttgcgaggggagaggaagtgcccgtggagggcggcaggccccctcatcccgcgccaattatcctcagctcgggccgtcccccgctcccgaaggctggccttaagtcacgacctgacccgctgcgcctcggcgtgcacttagaggagcccggagctcttcgccaagcgcagaactgaccccccgcaactccacccgcgggggcggacacctaccgtgggccgtgtcgggggcggctcccccaggtcgcctttcccatcccgggagctcacctgtgcgaagcggtcaaggacccgagcagctaaagggtgagtccccgccccactccgggtgccccccgcgccccggtcccgtccccgcgcggaaggatatcctgcagccgtttcaccagcagcgtcttcccgacgcccgtggcccccagcaggagacacattccgtgcttcgctccacccggcacccgtagctcggcgccgcggctcaaggcccgcccaccggccactctcattggatagttctcaccttcggacttctcattggttcttagggctcattgttccaagggcgcgtccaattagcgcgcagcgttagcgggagagcggaagaccccgcctcctcgcggctctagggccggcgcggtgacgtgcgcgtgcgcgcactggagggaaaaggcggaagcggaagtcggggggcgcgccagctcgtagcaggggagcgcccgcggcgtcgggtttgggctggaggtcgccatggggcgaggcagcggcaccttcgagcgtctcctaggtaacgcgtccccacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtggggtcggcgtccgtcgggcgttggcaaatggggctctgcgagggtccgcgcagggcgccaggggcgctcggcgacctcgctcctccgcgggcccgggcattcggccgatttcctcttgaccgacgagcacccggccgagtgggccacaaggcctgagtcatgaaagtgggtgactcagtcggatgttaggctcgcacttgggcttctgacccaaaacactgggcctcgaagggtggagccggcagtgttctctctgggaccttcgagctctcttgggggctgcgggtcccagacccaccttttgttcccacactggcttcgggaagtgcctaatggtttaggaaggcgttttctcacgtttttggaggtgaaagctgatcctatctgagcctcctggaattgacgcgttttgggagggaaacgaatgttgatgtgcacgtgcccagcagcacgtggaaaatgcgtctaatgtttgggggtaggagcttgggtggtcgaatgggctgcccaagcttgcctttttgtcaagtagggttttcaaggagacttcaagtgagacaccttccttgccaagggaaccagcaagcagactgagtatctcagccacacaggtagttcagtgcttcagggatgaatccagaggttaactactgaatcagtatagaaagtggacgtggcttggcttgttagatcgtttctgtatccgggaaaggcgatgtgggcagagctggagctgcccccccagaggggccagttgttggagacagcagtgatgtggtatgatgacaggtatgctggcgagtcctccttggagccccgttctgcccttatttccaaagcacttggcttggagcaaggggcctggagtctacactgcaggcctctctagcccttgcccaagctaaggtcccattgaaaccgggagcatctgggcgaacggggactccaagggacgggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgcttccctggggaggatggcacttccctgcccatcagcacgctcaggaggattctgtcatgctttttcatttggtccaaatgtctaaaggggaaggagagagtcccccccagctgctgccaagctggggtgctgcacggggcgtccagcaggataacccctccctttcatggcattttctctctcagacaaggcgaccagccagctcctgttggagacagattgggagtccattttgcagatctgcgacctgatccgccaaggggacacacagtgagttagcggggcctgtgccctgatgcggaggagcagccgtgcactaagctgggctcgcttggtgcccgttgggtctccacgacgtagctgaccgtgttaggctcttatgtggagaactgcatgggctacatgctaggattttttgacatcttggaggattaaggggttttctctgtacagcttgcagatacctggttatgtttgtatttgcttcggggttctcaaagactaagatggcagacagacttttttttttaagacggggccttgctttgtcacccaggctgaagtgcagtggcgtgatctcagctcactgcagcccctgcctcccaagctcaaacgatcgtcccacctcaacctcctgagtagctgggactacaggcattcaccatcacgcccggctgattttttgtattttggtagagatgggtttttgccgtaatgcacaggctggtctcagactcctgggctcaagcaatcctcctgccttggcctcccaaagcactgggattacaggcgtgagccactgcacctggcagcagatgagcttttctcatcttagttgctgagactatttttttcccgtttttctctgcttttatcaatgtttccttttcagagcaaaatatgctgtgaattccatcaagaagaaagtcaacgacaagaacccacacgtcgccttgtatgccctggaggtaagcagacccccgtgcctcagtggcccccagggtccctaccccctactagtcacgacagcatgagaagagtttgtcctgtggccttgcccacctccctgggcatacatcaagcaggagagtttccactcagccttgagtgcctgtgtgaacagtgccacctaggagagggtcacgctgagggagagacaggagataggggagggagtgggcaccacttcttcagccggtcctgcgtgagtaaacaccagaaggcggatgtcattgctgtgcttggcagtgagacttggcgtcacggagcggtgctgtgcaggctgctgagtctcagatgtgggttccccactggcctgacgggcctgttgaagggctgctgtcccaccgggttccccaccggccactgacgggcctgtcgaagggctctgctgtcccaccgggttcccctccggccactgacgggcctgtcgaagggctctgctgtcccaccgggttccccaccggccactgacgggcctgtcgaagggctctgctgtcccacagggaggtgggtctgtccgggaggaggaggggccctgccctgaccactggcccaacccttcccttcctgggcatctgcaggtcatggaatctgtggtaaagaactgtggccagacagttcatgatgaggtggccaacaagcagaccatggaggagctgaaggacctgctgaaggtgggtgagacgggggcatgcgggtggccacccaggctggcacctttgcttctccgggtgtttactgggcactgatgacagaacagcaccaggtgtggcggaaaatgtgcaggtgcagatcggtggtccctgcactgcgcaagctcgcactcatgagtcggagagacagggccgtgagccccaatccagggaggtcagggtttagcaggagccggcctggggtgctgtgtctggaggaccaaggtgacagcgaccctggggcctgggggaagcttccgggaggcagggcttgggcacctgctgtcttagggaaggtgagtagatgccactgggtgggcagggcaggtggtggctatcgtgtgtgagagtggctgtggtccggagggcaggctggccacatcccacaggcaggggcctgggagggctctgagcgggggcttgtaagatcggatgtgtctggcggggataagagctgttttggagagcgagggcttcatgctttcctgggcagaggaggaaaagccctccagatccccaggagattgtgccggggacatctgcagggattgtgctggggacacctgcagggactgtgatgtggactgtgatgcagtggggatgctgttgcaggtgtcaaggagaaagagtgtcccatgtagtcaggctgctccccttctgtcccaacctgtgggccagacctgggtctcataggagactccctggactcacacagctgagaacctgcccggggatcccggtggacagccaggcctctcaaaggccctcactggccactttggctggcttcctgtcccgtcctgtcctggctgagaggcggaaggtgccggagtctggccctgcccgaccctggtgctcctgagctccttcagtcaggctgcagatcctgagccggttcgctcctctggggtgaggcagggctgtgaagggaaggcgccgctgaggatgcagaggggttctggaaaggagcttaggctgaggtgcaagtgccccggagcctgcttgcagcagcctctgatcgcacgccgtcctgcacgtcacaccgggacggcgtccccgagagggccgtagacgcgaggccaggctgcgctctaaccgggggagaggatggctgcagggggtctggagcccgctctgaatttggaggcatttctggagcggctgccccccgcgtctccccggctgtgactggaaggaggggcgtggccagagccccgcagtacccctgtgttctcagccccaacaccacgctgccaccgtcaggcctgccgggtcctgcctgttggaggctgacgggaaccggggatcctggggtgggcaggtcccgtggggaaagggagagacagatggtcaggggcacagagacgcggcgttgtttggctccagcaagtagaggcaggcgtgaggtttgaactcagggtctgggaacaggttggtgcatggcccccacgccccactcggggggccctccctggcctctgtgtcagccccatctgctcagaggctgaggtctgccagctgcttcctcacaccgaggcctctggcgcctggagtgtcctgcgaccctcacccccttctccctgcctgcagagacaagtggaggtaaacgtccgtaacaagatcctgtacctgatccaggcctgggcgcatgccttccggaacgagcccaagtacaaggtggtccaggacacctaccagatcatgaaggtggagggtgagtcaggactgaggttgggaccaggttgaggcttggaactgctgggcagtcaggctcaacgggcacagtggcgaggggcctgggaagatgggttgttccctgtgttgggagggaggagggcggtggcctggagccagggaagaccgtgcatgtgagggcgggttcagaccggctcctgcctttctggacccacggcccacgggcaggggcaggcagtgatggcagacaacacacaggtgaaaaggcagcagacagcctgtttcagagtggcaggactcctgggggccgggttgggctgtgcagtcagggaaggcctctgaaggagctgtcccaagtgtcgagactggaacagaagccagagccggcgtgagcaggcaggcagcacccgtgggcagacactcagggttgaggccccagggcagaaaggtggccagcgtgccagaggagagtgcagccgggcctgtgcgccgagggcctccaggctgttgggctggagttcagggttgctgtcagcgcagcaggaggcctctggtgggttttcgtctaggtcgtggctgccaaggtgtgtttcttaagggtccctctcggccattgtggccgtggagaactaggggattgtgtagagagaggtgggggcttcaggatgcatttgggagtcttggctggtgctcagggcccactcagtgagagagaggtgggcatggctgctcacatctgtgcgggttctctgtggccctgagtctgctgaagacgaggctgagagcgtggggaatggggcaggctccaggggtggtgcgtccccgctgcaggagttggacgcttgccctgtggctgcagggtgggcaggaccagtgtggagaacacgggaagaacgcagggggcgctgcacgagctgccttggaccctcaactttggggtggtggatgctggtggtctgtgctcctgtctccttcctggggtgggagctctcctggattttttctggggtcgtgtgtcaagaatagctcaaggtcttgtcctcaggatcagtgggagccctggccagagagcagagggtgagggagccactcagcaggcggggccacgcaggggcctcatgccctgatggagtgggagcagtgtctcaggaagagggcagcagggcctggctcttgtctcccgccacagtgaggacagaggccccatggggacacccaatcttgggggcaggaggctgtctcggtgcccccagacaccttcacttgggtgcacggtcactgctgcgttgcagctgccgagagtgaggaaggggctcccggaagtcttgcaggccaggtgggagcaggcagtgactatggcttcatctctccagggcacgtctttccagaattcaaagagagcgatgccatgtttgctgccgagagagtgagtgtgggcggccgccaggggttctggagtcgggctgctcaggaagcgtgaaggggagtgctgggagcccggcttgtttgagggttggtggctgagctctcgtctgtctgggacctgaggatgcctgtgtgtcctgggcggaggcgtagcagctgtctctgcagggcgaggtggagacgtggcttgagggcctttagagtggctagggggctcgggaaaggaaaacaagcacctttgatgaggaaggaagtcccttcctcaggcctcggcagcttcaccccaggccacgccgctgggaagggccgcccggggcattgctctcgctcgtgctggggtcctctctgggtccgttgccttctgtggggcaggggaggctctgtgcctctggggctggtggggcgggaagcgtgtggtcctgactgctgcccctcctcaggccccagactgggtggacgctgaggaatgccaccgctgcagggtgcagttcggggtgatgacccgtaaggtgagttcccacctggggggctctacagccccggccagacaccaggtcccctgccgtgcacaaggccaccgtccctgctgggcctttccttcctggtgggtggttcaggaggtgagtgcagctcgcagcgggtggcagtgtggcgtcaggagggggacagtgagggcccacgtaagggcctgatgccactgcctgggccgggcccagcctcactctggaattataatgttttaaacctagggctacaggccttgccacagtcactctgctgcttgccagggccgtggggcccccttctctttgtggcttagcccatctggattcttaccctcgaggcatcttcacatcaaaaccccctccaggctggcaaccggcagtgcttggggtttggggtgtcagcagcttccagcacccactgcactcacaaaagctcttgttttatcagcagaattgatgtgtattttttccttgcccttacttttaacttaccttattttccccaaaacggtggctggcgttgagactcccgggagcatgtccaggttccccggccttagggtcttcccaggcacttgttctgcttgtcccttgccttcccccacctgtgaggcccagcttcggcatcgtacggggtggttctgggccgggtggcgcatcagggtcccccagtgcctgtgaccaggcccgcccgccccatcttacagcaccactgccgggcgtgtgggcagatattctgtggaaagtgttcttccaagtactccaccatccccaagtttggcatcgagaaggaggtgcgcgtgtgtgagccctgctacgagcagctgaacaggtgagtccccgccccccatttgggctgcaggtggggcaggctctccaggctgggttttctgtccctcttggccatggtgcctgaggcctgcagaccccagaggaccctcacagcacagcagctggaaggtcaagggaaacccagggtggccgcatgccctcggaccctgccccacactagggcaggtgggtgtgagagacagggcgccgcggctccagggaccgaggctgccccgacaaacctgttgcttgggtttgggtttgggtttgtttgcatttcaactttcggaataaaacttacagaaaagttgcaagagtagcacagagaagctgcggggccgcggccagtgcctcagcggtgggaacctgcggggccgcggccggtgcctcggcggtcggtgttttgtcgcagagtttactctgcctcccctctcctgcgcgtgcgtgtgttcacacaggttttattttgaatttgcatgagtgcagatgtcatgccccttggcactcagatcttcgcctgtgatctctgagagggacagtgctctcatggccacagcagtcactcgggactgcgctgccacccagtgctggcttctgctctgtggtccacgttccatttctgccgtggtcccagcagcgtcgctgtgggtctggcctgggttgcgtgtgtttcgtatgtgggccgtgctccctgcttggttcccttttcctggaacgtgtcactgcctccctgtctcgctccgtggacatttctgggaggtcaggccgtggccacctggccccctgttcaggtctgaggctcccacctgcttaggttcgggaagctcaggagtgaggccatgccctcctcaggacatcccatccaagccagccatgtccggtgatgggccgctgcccggaaagttccttttccttcttgtaactgagaagaacttgccttgagccacgtcaagtcccgtccgtcgcagccactgcccacaagcgtgagtctgctgtgagccagcggctccatggcagggcatcccagcgccattcctgccttcacacacacttgctgccgtttccctgtgctgggggctgtgcaggtctgcctcggtgtggacttttctcttaggaaagagccccaggtcggccgagcacggtggctcatgcctgtaatcccagcactttgggaggctgaggcgggcagatcacgaggccaagagatcaagacaatcctggccaacatggtgaaatcccgtctctactttttaagtattttatacttaaaatttttgtattttatacaaaaattagcgggcttggtggcagatgcctgtagtcccagctactcgggaggctgaggcaggaaaatcacttgaacctgagaggcggagattgcagtgagccaagatggcgccactgcattccagcctgggcgacagagcaagactctatctcaaataaaaaaaaaagaaaagagccccaggtcaaaggtcagcgtgcgtggttggaaattgcgaccatgctgtgagcctgcggcccttggactgcctggggcgccccggaagagcttactgggcatgacagtcactgacctgtttgccccttcttgggtggggcccgtcccacagtggcggtgctgtgtttggtttcccgagtgccgtaggaaggtcttcgcaggccgggctggtgtcctgaatgtccattttcaggagaggaactggggcttaccctgagggactcacccgagcccttgtggctggtgtgatgccctcgagtcctgccctgctctgctctggagtgtggccattcggacacctgtggctgtggaaccactgtcctcactctgtggggacacttagaggagcccgcagaggtgtggttgagagctttggcgggggcagggcggtgtcagcgcatggtgacctgcagcattccttgtgcccacaggaaagcggagggaaaggccacttccaccactgagctgccccccgagtacctgaccagccccctgtctcagcagtcccaggtactcagccccctccgtcccgtgggcacctcttccccggcgccccccctcaccctccccgcttgtcctcagctgccccccaagagggacgagacggccctgcaggaggaggaggagctgcagctggccctggcgctgtcacagtcagaggcggaggagaaggagaggctggtaagccgggtggggcggggcggcctcaggaggggcccagctcccctggatgtgctgcggtggggccggaggggcgtcacgtgcacccaagtgacgccccttctgattctgcctcagagacagaagtccacgtacacttcgtaccccaaggcggagcccatgccctcggcctcctcagcgccccccgccagcagcctgtactcttcacctgtggtgagcggcccttgggctggagctccctctcctggaaggcagtagggttgatgggggacgcgggtccctgagctgatttagtcaggttggtgggggatgcgggtccccgggcttcccagagaggacagccccagcacacgggcggacatcagggcagagccccacggctccaggcacccgttgctcctggtccctggttcggcccttgggactgaggacatgggacaggctgtgggggaggcgccttgctggtgagaccccgtctcttccacacccctcccgccccacaggaactgaaggacttgctttctggggcatccacgtcacctctccctggcctcagccccgctctcagtagagggtgaagaggcagcctgttttgcagggggttgggtcggggacagcaggttgagaaagtcattttgtaggttccgtggagtggccaggccgctgcaggcccaggggtgcagaacagccctgccccagtgagccaccccttcccttcttcccttccttccgggctgtcggctggggccccacacgctggaccgtgggggctgtccagtgtccaccttgaggccccagggctggcccagtgccaccctgttcctcccatagcaaggttaggagccttgtaggacggcagtgctgtcagcctctgtggagttctaagcatctggaagaggagaaaagatggctgctcagatgccaggaaccagaggagggcacggagggagggcccaggctgcggctctggtctccaggatctgtcgcactggggacatccctgtccctgccgaagcaactggctctgtcacctgtgagactcagatgcccttttctccccagaactcgtcggcgcctctggctgaggacatcgaccctgaggtaaggcccagcatggggtgcatcctctcacggtttctggccttgggagtgaccccctcattgcctgcagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggaggtgagggggccactcccggcattcctagtggcagggtcccttggaaggggtggatgcgggacaggttggaggccccactcattctctctcttccagaaccccctcccggagacagactctcagcccattcctccctctggtggcccctttagtgaggtaagctgtggctccctccacgggccagggcaaaacatggcctcctggcccacagcgccaggcacatggcacaggtgcctgccctaaccagagggccgtgctagagcaagggtgtctgccccagcccagccctggcctgccctgccctgccctttgtggcctctcccaatggaaactctacaccaggctgtggtccagagctcgggccactctctgtggacctaacatggacctgaatattccagagcagcctagaaccatcagatgagtccttggcgttgcctggggcttgtgggctggttggctgtcagagcacaggtccctggagagggagctggcagtggggccctgagccagctccgtcctgaccagggcttgcagctggacaaggaccccgcctccagggcctcgccttcctcagctgtagaaggggctgcttgcataaggagcagatggactctgctccaggcttgagtatagctgggtgcctccatcccaggccccaccagggaggctggctggggcgtggccgcactcatccagaaccctgctctgcctgcagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggcgtaggtgcccgcgccacggggcctcggctcaggggcagccaggtgttgtgagcgccatcctgggccagggcctcccctgagggtgctgagctcttgtgagtccttcattggggccgtggcttcctccagagagtgtcaacaggaggtggtctcagtgatgaccatgccctgccctgccctgccctgccctgccctgccctgcccaggaccctctgcctgcctcccccagagcccagcaccttcagagccctctgcagaaggttgggcacagggcggcccatctgcgtgtccgttccacccaggagcttctcggcactgtgccggagtggtcagggttgctctgtcatctgcccacagtgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggtgcagtggctgcccagccacaggccggggccggctgggggacctcgcagcataaccagcatgtttttgccgcacaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccaggcatgtgccatcctcccgccacccagaggcttgtgggctgaggaccaactctcaccgctgtctcttttgtccccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctggtaaggacgggtcggggcagagaccatgccttttatccctcgtctttattttagccgaatttacagaaaagcagtaagaatggtgcgaagggttttcccagttgccccgatgtgaatgttgtccctgctttttcctgtttccatgcaaacgcactcacacaggctttcctgctggagccgtgtttcagtccgtgcgtggcaggtactgccctctcccctgaatgcgacagcgagcatttcctgaaaccagcaggtgctgggctgccgatcctcgtctgtagcaggctcagccctcatggactgtcccagtggtgtcctgtaaacagcacgccccctgctgcgtggcatttgccccccccccccccgcctttaatctagagtgttccccagtcagcttctgtgttttgtgacatctactgtcccaagagcactggcctgtcattcggcagaccgtcctcagctcaggtttgtctggtgtctccacgcggtgaccataaggctgtgcttttctcagagtggcagccgaggtgacgtgcatcccgtcagtcccattgctggccgttcggctgagacggggtctgccaggggttttcactgtgaagtgactgttttgccctttacagatgtctcttgggggaggccttccaaataccctgggactcctcaaggtctagcattttttgctaatgttgcctgtgtttattacggtgtttgccaaatagcgccttctaattctgctgttgtctttccactggcgggaggtactcttccccactctcctgcttatcgtcagtcacagcagcgtggagacgtgtttattttttctttcaaaggtgacactcctctgtcatcactctttatttttagagtctcgctgtcatccaggctggagtgcagtgccatgatcatggttcactgcagcctcgacctcctgggctcaagcaatcctcccatctcagcctcttgagtagctgggactacaggattgcaccaccatgcctggctaattaaaaaaaaaagggctgggtgcggtggctcacgcctgtagtcccagcacattgggaggctgaggcaggtgggtcatgaggtcaggagttcaagaccagcctgccaggatggtgagaccctgtctctactaaacatacaaacattaggtgggcgtggtggcacgtgcctgtaatcccagctattcgggaggcagaggcagagaatgaattgagcccgggaagtggaggttgcagtgagccgaggttgcaccaccacactctagcctgagcaacagagtgaaactccatctcaaaaaaaatgtagaaatgaggtctttctgtgttgcccaagctgacctcaaactcctgacctcgagtgatccgcccttctcggccttccaaagtgctgggattacaggtgtgagccaccgtgcccagccccgttactttgatgctcaaagtttcccaggtgtggccatgggaggcgtcagtggcttctctgttgcgtagggccattggtttgggttgctcctgagtttctgttgctagatactctgtgctcgtcttgtatgttctcaaccctggaagcagccatttctccaaggagcccttgttccctttagtggagggtggtctggatcttggttagaagccaagatcaagattctgggtgtgctcacagctctaggttgttagcagacagagctggaaagtgtgtatgtgaatacaagtgcacagttgtgggtgcgtctgtgtatgtgcgaatacatgcgtctttgtatatgataaaaaccgtgagtgcagccaggtgcggtggctcatgcctgtaatcccaacactttgggaggccaaggcgcgtggctcacctgaggtcaggagttggagactggcctggccaacatggtgaaaccccgtctactaaaaatacaaaaattagccaggcgtgatggtgcacacctgtaatcccagctacttgggaggctgaggcaagagaatcactggaacctgggaggtggaacttgcagtgagccaagatcatgccattgccctccagcctgggtgacagagcgagactccgtctcaaaaaaaaaaaaaaaatccatgagttaattccagtacttgcaattttaatccaatagcacagttttcttttgcattgttttcaatatactcaattgctcagccctagaatacacaaaaagtagttttaagaatgctaacctggcccactgtggagacgatgcctcctaactggagtgtaacatttgtctgtagttcttgtcatttgtagcctgaggccgtggagtccagattttgggttcagaagttactggaattcactatcccatcccattggtcagaccatgtcactcatttcaaatacagtttggttcattttttctgatttcattccattctaggattctcctcccatccttgttggtttatcttcttttttgagacgaagtctcgctctgtcgcccaggctggagtgcagtggtgcgacgtcagctcacggcattctccgcctcccaggttcaagcaattctcctgcctcagcctcctgcgtagctgggattacaggcgcctgccaccatgcccagctagtttttgtatttttattagagacagggttttactatgttagacagcctggtctcgaactcctgccatcatgatccgcctgcctcggcctcccaaagtgctgggattacaagcatgagccaccacgccccgcctatgttccttttttttagaaacgtgaaacctgaacttggttccaaaagtcacaacaaaaaggaaaactcctggccgggcggtggctcacgcctataatcccagcacttcgggaggccgaggcgggtggatcacctgaggtcaggagtttgacaccagcctgaccaacatggtgaaacccgtctctcctaaaaatacaaaaacttagctgggtgtggtggtgcacgcctgtaatcccagctgctcgggaggctgaggcaggagaattgcttcaacccaggaagcagaggttgcagtgagctgagatcgcgccactgcactccagcctgcgtgacagactatctcaaaaaaaaagtaaaactcggccgggcgcggtggctcacgcctgtaatcccagcactttgggaggccgaggcgggcggatcacaaggtcaggagatcaagacaatcctggccaacatgatgaaaccccatctttattaaaagtacaaaaaaaaattagccgggcgtagtggcgtacgcccgtaatcccagctactcgggaggctgaggcaggagaatcgcttgaacccgggaggcagaggttgcagtgagccaggattgtgccactgcactccagcctggtgacagagcaggactccatctcaaaaaaaaaaaaaaaaaagtaaaactcaagagtagggtgtcccttcctctcctccctgttgccctggctgaaccatctcccctgtcttgtttgtcacagatcccagcatggtgagtgcctacatgtacccagcaggggccactggggcgcaggcggccccccaggcccaggccggacccaccgccagccccgcttactcatcctaccagcctactcccacagcgggctaccaggtacacaggaaggccgctcctctccttccagggccagccccagccccagccccagccccagccccttctcccatggcactcattccctccgcagaacgtggcctcccaggccccacagagcctcccggccatctctcagcctccgcagtccagcaccatgggctacatggggagccagtcagtctccatgggctaccagccttacaacatgcaggtacagtgacctccaggccctgctgggggccagggtgggggagcagttgatgatgctgagggtcctttggtgaggctggcaggcactgggtgggctccaccccttctgctcctccccctccactctctgggtgctccctgtggtcacctttggattgttgcaagccagaaacatccccgcctgcctggtcacagggctactctctcacatctgacgtcttctcacaacagaatctcatgaccaccctcccaagccaggatgcgtctctgccaccccagcagccctacatcgcggggcagcagcccatgtaccagcaggtgagccattcccggggcctcacagcggcacccgcagggcaccctcaggcttcacggtttagcaatgggacccctggccccagtggggattgtcccgtacgtctgctcacagggggagacgcatacccgaggccccttctcagcagacagaacgaggacacaagtctcagggcagatacgcgcatccgcaagtgtagacaggaaaaaccgtgaatttacttgaaaggcaaaggccgcatgagctggctgcatgagctgcagtccgtggacatggattacaagcacttgtgggtctgtggctctgctgggacaaaagccttcctccctgggctggggaagggaggaccagggccatgcctgctttcctcctgcacagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcatcagcgttttttctttaattaatttttttgagatggagtctcactctgtcacccaggctggagtggtgatctccgctcactgcaagctccgcctcctgggttcaagcgattctcgggcctcagcctcccgagtagctggactacaggtgcaccccattaccatgcctggctagtttttgtatttttagtagcgacggtgtttcaccatgttggccaggctggtcgtgaacgcctaacctcaggtgatccacctgcctcgggctcctaaagtgctgggattacaggcatgagccaccgcgcccgacctgcatcaacgtttgctcagggggcaggtggtcaggctgatggcccagctgcaggcagggtcatttccagcctgcccctccctgaggctgcgtgccagggttcatgtgtgccctccgcggctctgcactgaccccgccggtagctggggaggagtttgggcttggcgcctccttcgtgtagtggctgaagcttcccgggtgctcctcattcctgggaagggagtcgggtgatgggaacggtgggagctcagcgctccgagtctgcggccgggggccagcggggctgaaacgcgcctcctgagtgttgaaagcggcaggcgccggcctttgcacccagaggccagggcgtctcactcaccttcacatccaggcctcttaggggagcgcggctttggcttttccaggaaggaatggactccaacggacagggaaagaagaagtgtggagagacgggcaggataagcaggcactgggcccaagccgcccttggaggctctgcctgttctgatctgaaggcggaggctcagccgtgctctcccaggaagccacctgggcgtttggggctttagctaggaaagaggatgtcgcctgcggctgcgaaggcgccaaagcccagacctcgcgcctccgcccgcgacggcggcactgggggcccggagcgggcgggagacgtggattactgcgggcttcggggccctagcctcgaccgcgacgttcgctcgcatcgcgtacggacagaaacccgtgagcgctgaagaaagaacacctgaatccggagccccagcccccgtcgctcgtttgcgcgaccccaaaacctggcgggacgagggtcgcccgatgtctagctgccgccacagacgacgcttttgcgtctgcgcagcgcgccgccttgtgggtaatctcagggtgagacgaggctagcgcgaggtacggctagagcgtcatttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggtacgcgggatcctggggcggtccgggccggcaggcgggttagggggcagccgggcactgaggggtcgatccgggcgaggagggcggcggggccggcctccctgcagcggccaggccgggcttgggggtcccatcgggggcgcggggaggaggcctcccggtgcgcacgccccttccctcctgggccgtggaaagcgccggggtcggccccagatgaccttggacgattccctgctcctcccttggcctcagccttttccgcagcaaaggcccatccgtgggtgcggcgttttgcggccaggggcccccatgttttgggaggctttgcgcaggaagatgcacctaagtaatagtttcgccaccgctgggttgatgtagttcattcaaaccagaaacttgaggtttgagtggtatggctgcaaataaacacgtggctttctaaggctctttgaagaatttaaagtaacttgcaaatcttatcaatacggaccccttgaggtctgagaaccctggactgggaccaaggagctaggtaatttccggccctagtgattaccagcctgagcttatggcacccaccagtcccccagttgtcctgcccctctggtttctgcagccccttccattccaggactgacaagtctgttttaattgggggtgggggctaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaaggtatcgtgagagggtggcacagacccaggggctggaagtttcagggcccctgtgttttgttcctggtgtattttgggagtttggtaaattgtcaaaagtgtgtttgtccaggtgcaaggtccatgccaggctagttgcccctcctcagtaggttccggctggtgtgagggccagctgtggacactgttctctatctctgcagaaaacgttgaagatccaggatgtcgggcttgtgccgatgggtggtgtgatgtctggggctgtccctgctgcagcagcccaggaggtgagtcctgggcagaatgaggcatttctggggtgcccagttcgcctgtggcctcatgtgccgtggtcccgtatctcaggttctgcagctaccgtcattgtctgcagcctgcacacctgtgcggcatcctgcagcctcctgggacctactccctgccacggatgtgcacgactttgcatgtggagaccatgtttctaatggagggaaacagacactaagctgagagaggaaaaagaggctgggcgtggtggctcacgcctgtaatcccagcgcttcgggaggccgagacgggtggatcacttgaggtcaggagttcgaggccagcctggccaacatggtaaaaccccgtctctactaaaaatacaaaaaaaaaaaaattagctgggcctggtggcacatgcctgtaatcccagctactcgggaggctgaggcaggagaatagcttgaacccgggagactgtctcaaacaaacaaacaaaataaataaataaaaataaaaataaataaataaataaaaatacaaaaattagccggcgtggtggcaggtgcctgtaatcccagctacttgggaggctgaggcaagagaattgcttgaaccagggaggcggaggttgcagtgagccaagatcatactactgccttccaacttggcaacagagcaagaccctgtctcaaaaaaaaaaaaaaaaaaaaaagaggaaaaagaaaggaagaaattataccaaatagaacattgtaagcattgtggggaaaaggagggaagaggctcaaggtgggagggagagttccaagttcaaggtgggcttcaaagaggaggcagacattgtagaagagagcacggccttcctggcggaggacggggaggcaccaaggtcaccaggcaagagggtgtctgacaattcagggagcagcagcgaggtacaggctggcgcaggcgaaggggtgtaacaagcagctccgtccttgggtctttgcaaggaaaccagtgaacttgaagccgccagttgcgtttggtcatcgggttgcgtgaacctctccaccggagccctcccctcagcccctttcccccactggggaaccaggttgtgtactgtagagtgtcccatgttccagatgcgtggggtgcccatggggcagcatcactcatgcctgagaactggaaggtagtttaaaggctgattagattcaggccgagcgtttgggtaagaatagctgggattactgtagagcctgttgtgtaaactggattgcttttgaggagggagaagatgttattaatagccttcccaggccgtggggacacgcagccccctgccctcgggtggtgctgggtctccatgcgccacgtcagaagcgcagcgtgcccgtcagtcccatggcgggttgtcattttctcggcacacgtgcactgcagtgtggctgagaaaggaatggcgctgcttttatctacaaagcacttttggtgtcgttctttcctgtctcataagttacgctttctaagcgagaggggagtagagtattgagggaaggactgtgaagcatgtttttatttatttatgaaaccgagtctcactctgtcacccaggctggagtgcaatggcgcgatctcagcccccgcctcccgggttcaagcaattctcatgccgcagcctcccgagtagctgggattacaggcgcgcaccactagagacagggtttcaccatattggtcaggctggtttcaaacttgacctcaagtgatccacccgccttggcctcccaaagcgctaggatgacaggcgtgagccaccggagccaccactcccgtccgaggcatgttacaaagagttattgggcagacctgcctctgactagcatgagagaaaaagcaccagctggactcgcgaggccaaggcaggagaatcgcttgaacccaggaggtggaggttgcagtgagctgaggtcgcaccactgcactccagcctggatgacagagtgagactccgtctcaaaaaaaagagaaaagaaaagaaaaagcaccagctggttaaggattgatgagttgggagacgtgacttccaactccaggcttcgctggggcctccgctgcacctccctttggggctttagactggggtggcccagcagtggaggcgttagctccccccagccctttgtcacctggctccccttctttcctgctccctaaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggtctgtgccgcggtgggggttccgaggcaggttccgttgtggtggccagggcccccagtccctgactttgctctctctggcaggcaaagaagctggtggagtccctgccccaggaaatcaaagccaatgtcgccaaagctgaggcggagaagatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcagtgtgtggagtgccgtgctcaggccgggctgccgggccagtgcggggatccgggcagcgtgtggagtgcggtgctcaggccgagctgcggggccagtgcggggatcgaggctggtacgggatgggaggcttgttccctgcctcctcagcagacatctgagagtctacagacattcatcaggtccccggtgtgcagggccctgtcctgagaccccacagtgggcctggtggacggcagtggtgtggaggacctgggcagcgggaaccctccctgttttcagtgttggccctctttaaggcaacaggaagttcagcactcgcctgagaaaccgaggcagccttggagccggcgatgccacccctagcttaggctgcaagtacccctgaacctaaacccggccacggggctgcgcagggggattggggaggggtgtgggatgcacctgccatctgcagggttggggtgtcagctgttcctctggggcccttaagtggggtatcctgggacctgggcaaagcggcaggaggggcttgtggacatggggaccgggagtgccgtggtcagcttggagcactggtcactgtgcacttggtgaggtgtggcccagtgctgggcagcccttggcagccactctcgggctgcagaccccttggtgccactgctgagtacagggggtgtggccccatggcctggctggaacggccagggccttgctttgaggacccgtggccgccttttcttgggcacgcctgttttcagccaagcctgggagagaatcagcgaatttctgtctcagctggcccgtgaccaaggccagcccccaggctgtgggcccacaatgaggccagagacaggccatgttccgcacctgcttcgggaaacatgcctggtgtgatggccccgtaggctgccatgccctccagcctcagttttcctggtggaaggatcccttggatgggaccagaaaggggcaccgtgtgtctggaagctgcccactggctgggactcctgggggagcgggaggggcagggagtttcaggctcactgtgcgtgtacaccctgcctggcccaggtcctcttccaaggccttctggtagagtttctctgactaacctgctgtccccaggaaaggctgtcccaagccaagcctggaagtccccattggccatggtatccattttgaggggttaatggtcttccctcaggaggtgacactgccacctggagctgggtgcattctgcctggtgccctgctgaccccaactgcctttcccctctggaaggcagcgaacatctgagctcagggacgagccctgcttgaggtcagacagacatgctgtcttcatccaggctgcacccaggccagatagaccagcaaaatctctgcccgcgactcctcgctgtctaccctggctcaggcgtctgccaggccactcgcaggagccaccgagaggccctttcctccctgccgggggacccccaaaataacctgtggatgccaagcagcaggacactgcggtggatgccaggccgcagtcggaggctggacggggagccctgtcccgtgagcttgctcagtctgccccaaccacccccttgggcctaccgacataacttatgatccgtttgagaatccatcagggatccttgtgagtccccgacctgcagttctagattcatcatttgaaaaagcctctggccctggatgcatttcctgttttcaggattcctcgccttctgactgctctcccagcatctctagctcacggagttcacaaacttcagtcccctacagctccttgcacttttgttctattttttttaatgttttatttacttatttatgtatttatttttatgaaacggtgtcagtttgtcacctgggctggtggtgcagtcttggctcactgcagcctccacctgccgggttcaagcaattgtcctgcctcaccttcccaagaagctggaattacaggcatgcaccaccacgcccagctaattttgtatttttattagtagagatagggtttcaccctgttggccaggctggtcttgaaccttatttttatcttttttaattttaattttttttgagtgagttttgctcttgtcacccaggctggagtgcaatggcacgatcttggctcactgcaacctccacctcccaggttcaagcgattctcctgccttagcctccctagtagctgggattacaggcgcccgccacaacacccagctaatttttgtatttttagtagaggcagcgtttcaccacgttggccaggatggtctcgaattcctaaccccaggtgatcacccacctcggcctcccaaagtgctgggattacaggtgtgagccaccacacctggcctatttttattttttaatatagacacgatctcactctgtcacccgagctggagtgcagtggcctgatcaaggctcactgcagcctcagcctcctgtgcacaagcaatcgtcctacctcatcctcccaggtagctgggactataggcacgtgccatcatgcctggctaatcttttgattttttttagagatgtggtctcactgtgttgcgcaggctggtctgaaacgcctggcctcaagagatcctcctaccttggcctcccaaagtgctgggattacaggtgagagctgccctgcccagccttttttgttctttgtaaagctcttcagttcctgctccttacccgctgggccctgctctttctgctttggagcagttcttccttcagcagggagccagtgttctgtgggttggggggtctctgccagcagccagtttcagccctgtcttgcaggtggccttcggagggacaggttgcagcccaggcccgcccccctccttcctggagtgtctcacagactcaggggacactggccctccaggccctgcttcccccaaggtttccatccatcgcctcttgattcttggtaatcgggagccgatggatgcaactcatctcggtttacactgagtgagacaggcgctgtgggcacagccaagtctgcgggactcagtcaggtgtgagcctggatggccccggacaaggaagcctgtcctcttgctgggaaatttccgttaagatcgggccacttcccctgcttcctaacggttgagtctgtttgctctgggccttttaagcccagcgtgatccctctgagtccctgcggtgcatttgcgccatctccacgcttcctgttgagccccagcccaggcttggtgcgggcagtgctgcactgcactctcctggttgcctcctgagcacctccacccgcttccccaccaggcgtggctgtgttttcacccccagtgtccatctggcacccttctcgattgccaggtagttacggtctgtgtgggcaacacctgagggacccaaccaaaccaaggtccaggacacacttccgggcaggggtaccgcctctggttagctgctcactccccagcccaaatcttccgctgatgacttctggggtcagaggccacctaagggtctagaaaacagtctcctccagttggctacctgcctacgttggggttacggcccaataaacccacagccaagctgaaaatcctaagtgtgcgtcttgcgcttccgacacagccagggcatcgctggatgcgcagaggcagggctggacacattctggtgcttgaggggttccagggaccacgagttgtttttccggtgctcctcacccttcgccctggagggtgggggaggccggacagcagtgaccaagctggagctgcaggtcttcatccctgtggcccagccctaaagcagccttggggacttaaatttcattttgcccagcaggtgcacctgggccaggaacacaccagcgcctccttgttcttcgcagggaagtggaatccaagcaggggcccagatgcaggcaggcatctcctgggaacaagagccccagaatccaccccggggccccacttccagggtggttgcctggggcgtctggtcagagccagaccagaactgagcaggagcttccgggcatctgtgtgtgggaagggagaggcaagtccttcctaaccgccttttttcccagttttcattcagtctggccccaagcaggttctttttttcttttctttttcttttttttttttttttttttgagatggagtctcgctctgtcgcccaggctggagtgcagtggcgcgatctcagctcactgcaacctctgcctcccggattcaagcgattctactgcctcagcttcctgagtaactgggattacaggcgtgagccaccgcgcccggctcccgaagccggttttctgttctcttgcagctgggccggggctgagccctcggtgggggcaggggttgcagacctgtggacgcagggcccacgccgcacacacgtggcccccgccaggtgactcacgagccagcgcctgcgcggcggggtggccaccgggtgcaggttcagggccaggggccgggcctcctggggattggcagggcgcccgccgcggtcccatgtgcctggggccggtccccgggcggtggccttcggccctgcgctccggcctggagaagggaggacgccaggggcccgggggagtggaggcggccacgcagcagccccggagcacccgcgcgtccgcaggccgggcccaccgcgctcggcgcccctcgcggccgctttaaggcgccgggcccgcctcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgaggccggggcccgggacgcggggcggatgggaccctggcgccgccgagacgcctgcaaaggcagcagcccggccccacgcacccggggatcgccgcgcccggggctccctcctggagagcgcgaggaggcccccgacgcccggatggccgatcccgggtggccctccagtggtggccgccgagctcgaggcctgcagggcgcagccgcgctccccagcttcccagccggcttcccagttctcggcaggtggcgatccagccccagctctacactttaatacctggtgaccttgggggagtcacttggcctctctgagccacccacccccatacattcaagaacgctccttccgcctagttagaagttgtggggggagttctgtgaggtgcacaggtgttggcatctagagacgtgctggctgtagcatacccagggtgtgggccaagccgccccccacccaggggtgtttagcacaccgccggacgtgtccctgggcaagtggggtgacccgatgccccggctttgggctgcttccttcggagagctgcgtgggcactggaagcgatgttaggaccagcacacccccaggagagatgccaggagaccctgcacgcgtgtggtcctggccctatgaaagcgggcgtttctcagcacgagaagcagccaccgtttttttactttttttttttttttaatgcttatggggcaaaataagacagagctctccttgtttcccagggacagccaaggggcgttgttttctgaccgtgtcttgccacagagaacaaagaagaaagggcctgaggctttgcacagtctgcccagcaggccctgccctgtgaacctggctgtggtcactgggcagccgcctgtctaggggacctttattttagcagcctgtccaggggacttgtattccagcagcctttgaggggactggctttactaatgagcaacaatgctggtcgctgcgtgaaggccaggtgagcagatgtgggcgtcttggggcacctgagacctcactggtcctgggagaggccttcagagctcccaggccacaggcagccacggccagtgagatgcagccacagcgacaggaaggcgctggcatgggcagaagaagcgagcccctccttggcatcgggctcttcctttcctcctgggcgccgcacaggtgcccctcccccagggcctctcccacgttcatctgggtgttgaaggcgggacctgcgtgctgctgtcccttgtccggggtctgagccccactgccccttggccctccccaaccaggcgctctctggctgcagaacaccgcctgggggaggcgggactgccctctggcctgggagggcgggaggagccagctgctggcagcatatggcgctgtggtcagggtgtgctcctgaggactgctcaccaggcctctctgcctggccgtcggaaagatcttttaaagcttcttgagcactttgtcccatgtccctacagtccctaccgtcgcatctggccgggacgggggctgctacctgtgtggcccagtccctctgttctgctgggctcgcacaatgggaggcccctctctgtccccacccatctttgccgacccctgggcgtgcgttacggggccgcgcacgtgcaggtcacactgagcggcggaaggacttctttggggtcagtgctgggggtgggacccaggagctgggatcctgggccaggtgctggccttcctgtctggccctggccaatccccctactgccgggagctctcagctggccaggcgaggaggcagaggtcctgtgagtggtggaggccaacagaatgggaggttgtcgggctgacagcccccgagtgcctgcccacagctcctaggtgctttgcagaggaggccgctatgccctgccgccagccacaccgtccccttgtctgctgctgagctcctgctgcctttcaaggccttctatggctacctcctcagtctcccatggtcctgcaggctccctcgccgtttctgagcggccataaacgtttgtccctcttgagacgtggtgtggtggataaaaagtagggctctggggtctcctcgctgggcccaaatcctgatggcaccagcgggtgcgttacctctccatgcctcagtttcctcatctgcagaaggagaatggcgagcccctgcggccagtgcagccaatactcaggtggtacgcggggcgctcgcggggctcgcggacactctcagctccatgtccactggtgtggttgctgttggaaagcagtggtgtgagctggttccaggcacgggtgtggagtccccgggcagggccgtgggaggccttatcactgcctcctgcctcagtttccccctctctggatgaacctggcaccgatccctcggggtcgctgtggggtctgagagcactcactcccgcaggtgcatctgcagacgcagcaggaggtgaagctgcgcatgacgggcatggcgctgcgggtggtgcgtaccgacggcatcctggcactctacagcggcctgagcgcctcgctgtgcagacaggtgcgtggtgtgtgccagccttgggctcccagactggggctgagtcctgcagtggcatccaagctacttccgtccccttttcaagactttgtgcaaggaaggacccaccaggccgagagctggtgaccccagggtgcgcctcccatgggcacccacccagtttgcagggctgggcctgagaccgccacttactggtggggaagctgaggcccagggagtgagaaagcagggtgcagctctagatttgtgaactggctcagccgcatgctggcacagtggccttgggaaggcccctcagggtccctgtggcccctcgggctgagggggatccctggctgggccgggtggcgaggctgaggggtgtggggcgtgcccgtccctccaagccaggcccttctcccccagatgacctactccctgactcggttcgccatctacgagactgtgcgggaccgtgtggccaagggcagccaggggcctctccccttccacgagaaggtgttgctgggctccgtcagcggtgagctgccgggcgggagggggaggggcgcggggtggtcaggtcggccgaggacgccgtgtgtcagcacggctcatctctggggtttgtgtcaccgcaggtttagctggaggcttcgtggggacgcccgcagacttggtcaacgtcaggttggtgttcccccaccccacctgcaaggccaggggctttcttgtccccagacatgccagggcctgccagggctgcttgcagggtggggtcagcctggaataagccactgagaccctggtgtcctgggcataggagggtgggtgtccctgagccccggcgtgccctgtcctgtgggccccgctgaccagcgtgagctcccctgtgctgccagggctgcccatgcccctcggcccgcccgcccctcccgccacctgcttctgtttcaggatgcagaacgacgtgaagctgccccagggtcagcggcgcaagtgagtcatgggcggccttctcggggtggttgaggtgcaggaggctcgggcgggagcggacccctggctgctctgccgtgacccagctgaggctccagcaggccgaggtgcctgcacggtccatggagggtcctgacggctgttctggactcgggggtgtcactctgcgcccccaggacctttgggttcttcctgtggggagagccttgttggattgggggctgggcctgtttgcaccccagggtggtgagtgcggaggcgaacgccccaggcatggagagagcgcatgcaacagaaacgcccgaaggaggcgctgcctccctgcccagctcagggcagctgtgccctcctgccacggcctggggtctttccagggcccggggtccgctccaactgcagtgtgagccacttcccccgccccttccaaggacccctggggagttctggcttctagctgtgcacacagactgtgttcccccaggaccccgggggctggcgggcaggaggcctgcatgctaggagcggtgcccagccagggactctgttggaaacgatggaacctcctccctgagggccgggcggggcgggcgaggtggctgtgggacgtcaggaccagcttcatgttcccagggagagatcttcaggcccatgaggcctctgcttcctcgagaacccccggcctgcctcggggcctgggaggaccctctgtgggagccggtggtcagggggagtctcatgtggtcattctgtgtccccggcagctacgcccatgcgctggatggcctgtaccgcgtagctcgtgaaggtgaggggcaggtgctgtgcacaggcagggttctggggggcaggcagggtgggcagcgctgtagaagactgggcgctgagggatttgggccaggtgcctggcctcaccccttgcctcaccccttgcctcaccccttccttgtgcagagggtctcaggagactgttctcgggtgcaaccatggcatccagccgaggggccttagtcactgtgggccaggtaggcctcctgcgtggggtgggtgtgggcagtgcctgtgaccactgacctccatcttcagaggggccatagaacaaggcactgggcgccaaaaccctcctggggagccaccagctgtgaccttgtggggcagggtggggggcacgggtgggtcagggctgcagcctgtgaaggacctcgggcaggtgcctcccctgtctgggcctcacggacggacagacggagcaggtgcttggccattgccaggtggtgtcgcctggggccctgtgtgctttccccaagctggggtcccccctacagccctgaccgcccttgtgcccctgcagctgtcctgctacgaccaggccaagcagctggtccttagcaccgggtacctctctgacaacatcttcactcactttgtcgccagctttattgcagtaagtggccggcatggctagggtgggcgtccctgggccggccttgggcgctgagggcacccaggatggggcgagggctgggggaggcgggggccttgggcatctggcagtgccccctggggctcataagtggggtgccagggctttgggagctcatgggtcagcctggtgcccccgccagcatgttcctggcccgccctaggagtcaggtggaggttctggcacgtgggtgggattcggcgatggtgcctggcgtacctgacaggccgctggtgacgagccccctcctcagggtggatgtgccacgttcctgtgccagcccctggatgtgctgaagactcgcctgatgaactccaagggggagtatcaggtgagtggggccctgcctgtgcagttgggctgcacagcccagcgagtcccctcacctctccggggggtggacactcgcactggggacccggggaagggtgtccctcccttctagttgcctgtctctgcacagcacttgccttgggagagggttgtgcctttgaatgcctttgccttgtttttgtttttagagaagacttcttggcccggcgcagtggctcatgcctgtaaccccagcactttgggagcctgaggcaggcagactgcttgagtctaggagttcaagaccagcctgggcaacatactgaaaccctgtctctaccaaaattacaaaaattaggggccaggtgcggtggctcatgcctatcatcccagcactttgggaggtcgaggcaagcagatcacctgaggtcaggagttcaagaccagcctggccaacatggtgaaaccccctctctactaaaaatacaaaaaattggctgggtgtggtggcgtgcgcctgtaatcccagctactcgggaggctgaggcaggagaatcgcttgaacctgggaggcggaggttgcagtgagccgagatcacaccattgcaccccagcctgggccacaagagtgaaactgtctcaaaaaaacaaaacaaaacaaaattggtcaggcttggtggtgcatgcctgtagttccagctacacaggaggctgaggtgggataatcccttgagcccaggatgtccaggccacagtgagccgagattgcaccactgcattccagcctgggtgacagagtgagactgtcttaaaacatttcttttcggccaggcacggtggctcacgcctgtaatcccaacactttgggaggccaaggcgggcagatcacaagtcaggagttggagaccagcctgaccaacatggtgaaaccccgtctctactaaaaatgcaaaaaaattagctgggcctggtggcgcacgcctgtaatcccagctactcaggaggctgaggcaggagaattgcttgaattcaggaggcggaggttgcagtgagccgagattgcaccactgcactccagcctggatgacagagcgagactctgtcttaaaaaaacaaaaaacaaaaaaaaacacatttcttttctttcttttttttttcccctcattgcaacctccacctcctgggatcaagcgattctcctgcctcagcctcccaagtagctgggattacaggcgcccgccaccatgcccggctaatttttcatatttttagtagagacagggtttcaccatgtcggccaggctggtcttgaactcctgacctcaggtgatccgcttgcctcggcctcccaaagtgctgggattacaggcacgtgccaccactcctggctaatttttgtatttttagtagagacaaggtttcgccatgttcgccaggctggtcttgaactcctggcctgaagtgatctgccgcctcagcctcccaaagtgctgggattacaggtgtgagtcactgtgcccggccaaaaacatttctttcacagattaacagaggtggtgccgttcatggcagtctgtgcctcataggtgctctgggtctcctgtcttgggcccccgccaactccatggggcttccacgtttgcagagcccatagctctgtcccttttcttctccctgacgctgccgtgctgcatccctgattctcatggttctgttcacagccccctctgcccactggaccccgggctgcaccctcgggccctggttgtaccgcatgagcaggcagggtggccgttgacctggctggtgcctgcagacctgtggtcacctgttaccagccagcagccgccgctcacacccacacccacacccacaccccacattgagaatgcccaggccaccgtgcctggctggtgcctgggaggggattttcgttgccttttgggtgagaagcagcctttttgattgtttcactgcgttttctgcagggcgttttccactgcgccgtggagacagcgaagctcgggcctctggccttttacaaggtgcagtggtggcggcagtggcggcttgggcaatggggagcgggccccttcgggctctgtgtctctcattttccctgtctccctccagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgccacatctgttcctgcctgcgctgcctgcccgctggctgccttgctgtccagaccagcaggaccccctgcaccccctaaggaggaccgggccaaggccttttggggaggagccagggtcctcgctgtgcatttggatgaaggaattggggaagtaggaggaaccaaaaccggtgtggggggaagggaacaagacggtgaggctggggttgagggtctcagacacaggatctggctctgtcattcagactggagtgcagtggcacgatcttggcttactaacctgggcctcctgggctcaaaccagtcttctacctcagccttccaagtagctggtgctatgggcgtgcaccatcatacctggctaatttttgtatgtttttgtagagttggggtctcacaatgttacccaggctggtcccaaacttctgagctcaggggatctgcccattttggcctcccaaagatgcccttttttttttttttaagacagggtcttactgtgtcactcaggctggagtgcagtggcgcaaacagcctgtagtcccagctacttggaaggctgcggtgggatcctttaagcctgcaagttcgaggctgcagggagctatgatcgcaccactgcactccagcctgggtgacagagcgagaccccatttcaaaaaaagaatgtaatggtgggccgggtgtgatctctcatacttgtaatcccagcactgtgggaggctgaggcaagatctcttgagcccaggaattcgagactagcctggacgatatggtgagatctccatctgtacagaaaatttaaaaattacctgagcgtcatggcatgcacctgtagtcccagctacttgggaggctgaggtgggaggatcacttgagcccaggagatttaggccacgatgagccatgattgcgccactgcactccagcctggagaacagagcaagaccctgtctcagaaaaaaaaaaaatctttgatatccttgaatatccattcagtgctcaagtttctctgactgccatgtgcattttgtgaagagctggttttgtttgaactggggaccagtgggagctctgaggtttgtacatggtacccagtgcccaggttggaaattcacacccagggagtggctgggtaggttcagggggaaggctgctgcttcctgagaaaccaggtggttcagaaaggcagctctagccagcaaatcccaaaatctgcagatggagggaccacattctcagagctgctttgatgggagccctggaggaagcggccatcatgacagggcaccggggccaccccagaggctggcatcacccccagcccctccctgcagtcagccccactgggacagtgccagtcaggggatgaaagtgcccagtctggtttggcagggccaggcctggcagtgggccaccacagggcagggtgcagagggtggggtgggagaggaggccagtgggcagggctccttacccaccctccacagaagccacagctccccaggtccagggcacaggcccagggtgggggtaggtcagaggggatgtcagtcctgtggtttcatggcccttaacccacaggccctgcaggccacctggtccgaaggccagaagccagtcagtttcacgcttgggggccagggagagatctggaccctgctgagtcagcatttcagcagtcacctgctgagtcagcagtcatttccgtgcttttttttttttttttttttttctctccttttggatggatttttgctctgtcacccaggctggagtgcagtggtgaggtctcagctcactgcaacctccacctaccaggttcaagcgattttcgtgcctcagcctcatgagtagctgggactacaggtgcacatcaccaagcctggctcctttttgtatttttagtagagacgaggtttcaccatgttggccaggctggtctcaaactcctgacctcaagtgatccacccccttcagcctcccaaaagttctgggattacaggcatgagccgccgcatccagcctccatgcatttttttaagtgacttcatagtttacaaaaagttacacaataatcatttattgtcaagaaatttcaacaaggatgccaagacaattcagtggggaaagaaaagtctattcgcctggcgtgggggctcacacctgtaatcccagcactttgggaggccgaggcgggtggatcatctgaggtcaggccaacatggtgaaaccccatctctgctaaaaataccaaaaaattaccgaggcatggtggagcacaccagtcccagctactcggcaggctgaggcaggagaatcgcttgaacccgggaggcagaggttgcagtgagccaagattgcaccactgcactccagcctaagctagaagagcaaaactgtctcaacaacaacaacaaaaaaacttctgtgctttaaaggacactatcaggaaagcgggagacagcccgcataatgggaggaaatctctgtaaatcgtatcagataagggactacagtctagaacatataagaaaactcttacaagaaagaaagttgttaatggcacaggatgggaaagaaggtatacaaatggccaataaacacaggagacaccactcggcattatcagttgttaaggaaatgcaaatccaaaccaccacagatgcggcagcatccactaggctaaaatcaaaaggacagaaactgagcaagtgttggtgaagctgtggagaaatgagaaccatccagcgctactgggaatggagggtggtgtggccgctgtggaatagagtctggcagttcttcaaagtgttaaacacagttaccatctaacccagtaattccacgcctctgtacgtacccaggaggaaagaaaacatgtatttatagaaacttggacacaaatggagatgggcgtggtggtgcgtgcctgtagtcccagctacccaggagtctaaggtggaaagatcacttgagccccgtagttcaagactagcctgggcaagttagtgaaactccatctctacgaaaatttttaagtattagccaggtgtggtagcgcacgcctgtggtcccagctgttcgggaggctgaggtgggaggatcacttgagcccaggaggtggaggctgcagtgggctgaaattgtaccactgcactccagcctgggcaacagagtgagaccctgtctcaataaacaaagaagcaaaatgaaaatgtagggccgggtgcggcggctcacacctgtaatcccagcattttgggagcctgaagcgggagaatactgaggttagaagttcaagaccagcctgaccaacgtggtgaaaccttgtctctactaaaaatacaaaaaattagccgagtgtggtagtaggcacctgtaaccccagctaaggttgaggcaggagaatcgcttgaacccgggaggtggaggttgcagtgagctgagatcgcatcactgcagtttagcctgggtgacagtgcgagactccgtctccaaaaaaaaaaaaaagaaaagaaatgtagcatttaggagcacatactgaggtggtaaaacaaaaaaggggaaacagtccccataaagtcagaagggtgtgggttgggaaacctgtaactgggaggtggcaccagtggcttctggaagcttctggaacactggttctgctccccactatggcctgagcgtctgccttatcatcaatcacttggctctccatattttctttttttttttttttttttttttttgagacgaagttttgctctttttgcccaggctggagtgcagtggtacgatctccaacctctgcctcccgggaggtatgatcactgcaatctctgcctcccgggttcaagcgattctcttttctcagcctcccaagtagctggcattacaggcatgcgccaccatgcccggctaatttttgtatttttagtagagacagggttttgccatgttggccaggctggtctcgaactcctgacctcaggtgatccacctgccttggcctcccaaagtgctgagattttaggtgtgagccaccacgcccagcctgaagctcatactttaaaaatatttttttgtgtgtggccgagggcagtggctcactcctgtaatcccagcactttgggagactgaggtgggccgatcatctgaggtcagaagttcaagaccagcctcaccaacatggagaaagctcgtctctactaaaaatacaaaattagccgggtgtggcggcccatgcctgtaatcccagctacttgggaggctaaggcaggagaatcacttgaacctgggaggcggaggttgaagtgagccaagattgtgccaccgcactccagcctagggaaccacagcgaaactccatctcaaaaaaaacaaaaaataacaataattattattatttttgagatggggtctcgctttgtcacccaggctggagtgagatggcacaataatagctcactgcagcttgaacttctaggctgaagcgatcctctggccttggcctcccatagccctgggacagcaggcatgagccatggcccagctggttttctgaagttatggagatttttattgcagtctcgtacccgctacacttttgtgaaccgctgcatgcacgtctgaaaagaacacgtgttgtctcttggttacacagcttaatttgggtattcatgactttttgattaggcatgctaattgtaatgtgcaaatcttctttttttttttttttttttttttttgaggcaaggtttcgctcttattgcccaggctggggttcaatggctcggtctaggctcactgcaacctccgcctcctgggttcaagcaattctcctgcctcagcgtcccgagtagctgggactacaggcacctgccaccacgcctggctaacttttgtatttttagtagagacggggtttcaccatgttggccaggctggtctcgaactcctgacctcaagtgatccgcctgccttggcctcccagactgctgggatgacaggtgtgagctgccatgcccagccgtaatgtttaaatcttctatgtccttgcttggttatgttgagccaaccttgtaaattctgagattgcgtgtgaaaggttctccctgtggttctggatctgtccaatcctctgtgcacctcacagtccttcctgacgtgatccagctccgtgtctgcgcttgccgctttagtctcaggtaaacatcttagtggcacagagcccaccagtctgcccagacaggggagaggcgggtgagtggtggcaaaccatgtgacccagttcttttttttttttgagatggagtttcgctcttgtcgcccaggctggagtgcagtggcatcatcttggctcactgtaacctccacctcctggttcaagtgattctcccgcctcagcctcccaagtagctggcattataggcatgcgccgccatgcccagctaattttatatttttagtagagatggcatttcaccaggttggccaggctggtcttgaactcctggcctcaaatgatctacccacctccacctcccaaagtgctgggattacaggcatgagccactgtgcccggcctccatgtgacccagttctgatggcaagacgtgaggagagatgccctgggagccctgatgcagtccagcctctgtggacacacttctgatggtcacacagttacgtttggcagaccattctttttttcagtgatggaatattcttctaggtcctatgtaatcattgttgttttcacttctattttgtctgatgttaatatcaccgtacctgccttatgttctacctttccgggtcattttgttttgggtgtgcataaatactcatgtggcaattcaggccggacgcagtggctcgcgcctgtaatcccagcactttgggaggccgaagcaggtggatcacttgaggtcaggagttcaagaccagcctggccaacatggtgaaaccccgtttctactaaaaatcaaaaattagctgggcatggtggcgcgcacctgtagtcccagctactcgggaggctgagacaggagaatcacttgaacccaggaggcagagattgcagtgagccaagattgcaccactgcactccagcctgggctacagagctaaactgtctcaaaaataaataaagtaataaaataataaaataaatagtcacgtgatgcttcaggtcatctgacatcctgccccccaccccttagtaaaatgcctgctgttttattcaagcagctaccaccccaccccagtccttgggcctcaagggcaccagggcctgaccccagctcccagcatgaatagggttggtttaaaccagtcggcatggcccacagtgactggtttaggcatgggcctgtcacccacactgggccaatgatatgtaagatgtttattgtagcttccgggatggaaacttctctgccagcttgtgggttgggcaaggacgacactccgggccctaccggcggaagctctgctcctgtcgtgcgtggaccacgcagcaaatggccttggaggctgctggcagccatcttgtgaccatgaggcaagtcagcgcaggccgaagctgacgacgcgaagacaatgaggagagggagaaagagccgatctttggtgtgtattggctgtgacgtgctgccgcctctctggagaccgggttcattatacttttcctggtatcttctcatgtttgctctgctggctttgggcccgagttttacctcctgggtgtattgtgtgtgcctgttttgtggtgttggttttgctcctgggtttgttgacccttgggtgtctgctcttttttttttttttttttttttttgggacagagtctcacgctgtcacccaggctggagtgcagtgacctgatcttggctcactgcagcctctacctcctgggtacaagcgattcttctgcctcggcctcctgaatagctgggattacaggtgcctgccacggctaatttttttacttttagtagagatggggttttgccatgttggctaggctggtcttgaactcttaacctcaggtgatctgcccacctccgcctcccaaagtgctaggatttataggcatgagtcaccgtatccagcattttttgcttgtttgtttgttttgagacggagtctcgctgtgtcacccaggctggagtgcagcggtgtgatctcggctcactgcaagctccgcctcccaggttcacaccatcctcctgcctcagcctcctgagttgagtatctgggactgcaggcgcccgccaccacgcccggctaatttttttgtattttttagtagagacggggtttcaccgtgttagccaggatggtctccgatctcctgacccggtgatccacctgcctcggcctcccgaagtgctgggattacaggcgtgagccaccgcacctggccagctctagctggttttacgggtgaatttttaccaaacattcatggaacagaaaaatccgtgtcttgaaattttcacagaaggctagcatgatctcaactccaaaatgaaaattaagacacatctgtttcatgactgtagatgtagaaagcctagataaactattaataaattgaagtcagctgcatataagaaatgtcagacctcatgatcacgtaggggttatatcagaatttcaatgtcaggaaactaactaatgttatctgcatgttacattaagagtaaaggaggctgggcgtggtggctcacgcctgtaatcccagcactttgggaggccgaggcaggcggatcacctgagctcaggagttcaagaccagcctggccaacatggtgaaaccccgtctctagtaaaaatacaaaaattagcccggcatcatggagtgtgcctgtagtcccagctactcaggaggctgacgcgggaccctcgcctgaacctgggaggtagaggttgcggtgagccaagatcgcaccattgcattccagcctgggcacgaagcgagactccgtcaaaaaaaaaaaaaaaaattaaagaataaaatttctgcaggcatctcaacagctacagaaacagcattttgtgcaattcaatactgatttgcaggggccaggggtcatggctcatgcctgcaatcccagcactttgggagaccaaggcaggtggatcccttgggctcaagagttcaagatcagcctgggcaatgtagcaaaaccccatctaaaaaaataagaaaatattaggcaagcatggtgcatatgtgcacagggcgcacacctgtggtcccagctactgggggtctgaggtgggaggattgcttgagcccaggaggttgaggctacagtgagccgtgatggtggccctggactccagcctgggcaacagagtgcaaccccgtctcaaaaaagaaaaatactcatttgcaacttttatttttttaattaaaaaaaaatttaatttatttatatttttggggacagagtctcgctatgtcacccaggctgcagtgcgatggcatgatctcagctcactgcaacctccaccttctgagttcaagtgattctcctgcctcagcctcctgaatagctggaattacaggtgaccgccaccatgcctggctaatttttgtatttttagtagagacggggattcaccatgttggccaggctggtctcgaactcctgacctcgtgatccacccatctcaacctcccaaagtgctggggttacaggagtgagccaccgtgcctggcctcatttgcaatttttaaaaattgctttgcaatgccgggcgcggtggcttacgcctgtaatctcagcactttgggaggccgaggtgggcacatcatgaggtcagatcgagacgatcccggctaacacggtgaaaccccatctctactaaaaatacaaaaaaaaaaatagctgggcatggcggcgtgtgcctattatcccagctgctggggaggctgaagcaggagaatggcgtgaacccgggaggcggagcttgcagtaagctgagatcgcgccaccgcaccccagcctgggtgacagagcaagactccatctcaaaaaaaaaaaaaattgctttgcaacctagtagtagaagaacaattccttgatctgataaagagcattcccttaacaagatatagcaaaatttaaaacccgtgaattatagaaaagatacacatttgattatataatatttttaaaaatatgcatggcacaagactctataaacaaatatacacaatggaagccatggtgggaggtatcggccagggccacgtctgagtccttggcagagctgggtcacgcagtgaagagctgggaggggcctggacagggcagcagtgggtcaggtttgggcttaaagaagacgtcccagctggtggttcttcaaacaattaaacatacagtggccgtgcaacccagcaatgccactcctaggtgaggacccaagataaatgaagacgtccggccaggcgcattggctcacacctgtaatcccagcactttgggagccttagacagatggatcactttcagctcaggaattaaagaccagcctgggcaacacagggagaccctgtctcgttaaaaaatacaaaaattgccaggcgtggtggctcatgcctgtaatcccagcactttgggaggccgaggcaggcggatcacctgaggtcagtagtttgagaccagcctgatgaacatggtgaaaccccgtctctactagaaatagaaaaattagctggacgtggtgactaacacctgtaatcccagctactcaggaggctgaggcagaagcgcttgaacctgggaagcggaggttgcagtgagccgagatcacgccattgcactccagcctgggcaacaagatgaaactccatctcaaaaaaaaaaaaaaaaattagctgggcatcgttgtcttgtgcctgcggtgccagctattctggaggctgagattggagaatcatttgtgcccagtgaagcagaggtggcagtgagccaagatcatgccactgcgctccagcttgggtgacagagtgagactctgtctcaaaaaaaaaaagagtctacataaaacattgtgcgcgcctgtgcatagcagcacatccataatcacagagaggcggaaacagctgtgtccatcaacagaggttggtcacacagggggtcctgtgcccaatgcagtggactcttgggccttagaatgaagttctgatccacacggcagcaccgacggaccttgggcactgtgctgtgtgaaataagcagacagatgctgtgtggcagcacttacaggggcatcctgagcgactttgtggagacagctcttagggctggggagggagggatgcgggaagggggcgggagctggagggtggagggctctttctgagatgaggaaatgatctaaaactgcctgcggtgacggctgcacagctctgaagatgcagaaactcgctgagctggacgcattctgaattgtgtggtatgtgaattatgtctcagtaaagccattaaaaaaaaacacccaggagccaggcgcagtggctcatgcctataatcccagcactttgggaggcggaggcaggcggatcatctgaggtcaggagttggagaccagcctgaccaacatggtgtaacctcgtctctgctaaaatacaaaaattagctgggtgttgtggcgggcacctttaatcctggctacttgggaggctgaggcaggagaattgcttgaacctgggaacgggaggttgcagtgagccaagatcgcgccattgcactccagcctgggcgacagagcgagactccgtctcaaaaaaacaaaacaaaacaaaacagccaggcaaccaagtagacaatggagggagggggtgacagctgaggacgcccattgtctgctggtgctccaggcggtgctccccactcccagcccagtcgccccctgctcctggcctggatttgaggcctagagagacacctgccctcccccggatccgtgccccgcagaagtgcagtcttggtgcccaaatgtgcgcccgctggggcagaggagaatccgcggggcctgaagcagaatcgcgccctccccccaacctgccggctgcccgggcgctccccatgggcccagacgcaggagacaaaggagaacatgggggttcaggtatgcactggggcgcagacagggccaggcaagacaagagggcagggctgccgggaaggacgagtgcctcgggagcctctctgcaggtgagacacaggttgaagcattgactgatttgttctctcgcagtgaggcaggagaggagggaataattggggtgacccagggttgaggcgtgagcaagagaacagcaaaggcagctggttctgggtaacactgggcctcactcctatggtaacaagacagtttccacttcagcctctgattggctgtgagccagtccttcataaggagtcaccagttggaggcctctaaagggcacctggggtgttaccaaattctcctggcttcctaaaaaccctggggagcactgccatagaggctctggggccgcctgctccgcccgctgcctctctgtgaattgcaccttgtggtcttcaatgaatctgtgctttcgtcactccgttttttgcttgtcttgtctttcgttacttcattcttttgttgctttctttgtgcgtgttcaattctttgttctgcacacaagaacctaaacaactcacagtcgagaccttccaaccagtaacaccagcggcccctcccctgggaagcctccagaggacgggaggctgcctgtaaaagctgaagagtcctgagtcttctgcgtgattccagagactcctgggatgccctggggtggggggcaggggaacgctggggcacgggtggacccaggaaagagacgtgtagagcgccttgccccaccaccctcctcccaggccatgtcatctgccacccaggccagggctacacctcacctgccactcaggccataccataccctcacctgttgcccaggccacacccacatcctcacctgttgcccctcctccttgcggcccaggaggtctctgaagatgcaggctctaccttctgcccggcccccagccctccacccgagaagtggatgtgaagtcactctgtgcatctccgcccctttcccacccattggcccttgccctgctcagggtcccacgctcttccctcctcctgcccctcgtggcccctcctgtctgccctggcccccccacacatccagggggcagtttgcttcctccactgacctcccctctctgtgacattatctgtttttacaaacttcaggcatctaagccgggcacattggcccaagcctgtaatcccagcactttgggaggccgaggcaggcggatcacttaagctcaggagttcgaaaccagcctggccaagatggtgaaaccccatctctactaaaaatacaaaagattagccggctgtgatgacgcgcacctgtaatctcagctactcgggaggctgaggcacgagaatcgcttgcacccaggaggtggaggctgcagtgagccgagatcacgccagggcactccggcctgggcgacagagtgagacttcgtctcaagaaaaaccaaaaatccaaaagaactacaggcatcggctgtgtccccactaggaagccggaggggagcagggctgggtgtgtcttctctggctgcgtccctgcggccacaaggcctgttcttcctctgtgccccgcctgccaaggacccagccttgtgaaggatggatgaatgaatcattgagcaaatgaatgagtgtgtgaacaggtgagtgaggagaagccggcagaggcggtggggtggatggtccacccggctggccagcggcctgtcactccctgagtggcctctgggtggcagccatgtggcgctgtcggctcaggaaggcttggtgctggaatggggctgggacatggccagccaggcagggtgaggagggtggcagcgcccagtgcagcctggacagatggggttctgcccggcagggctggcatgggggcttctttatgccaagccagccctgggggaggcctcggctgtccagggtgaaacagggtcagggtgatcaggctcggtttgtgggggcggcctgtcctgctggagggtcctcctcacccaaccccagcctgctgcaggctgtctgcaggggagatggcaaagacggtgttgtccagtttgcttgggacatgaatggtctggcaaatacgcaatgacacagctctggggtccagatccggcccaggcggccgcctgacagaggaggtgcccacagagcttccgtgagagggcagcccaggcccaagcagcactagaaccccggctttgggcttttggggacttagccggccccggggccaggggtaggatcaggtttccacaggccagacggccccgcacagtcaccaccgtcaccgtcaccatcacccggtgctgggcgggcaccatgtggactccacttggcactgggccgatgggcggatgccagagccagagcaaaggcctcgttagcccctcggggagggcacggcagggccgggcgactcaggagggctgcggggtgacgtctgattgagcctggaaggacaggccgaccacaggatggaggccacagcatccttcccggagtctgaccccacgctggagacagaggggctgggctgggctgggcaacctagacccgggagcccatctgtccagccaccagcgtccgtctgtctgggtccctgctagggagagtctgcagcagggagaccccggcagcttcgagtatggaggggagactctggccgcctgaggtgagtaacgttgggggatgattgtggggctccattgggacttggcagggctctgggggtgggcactgcaggggaagcagctgcaggcagggtgcagaggaggctcagctgagtctcccgcgtgggacttccaacccctccagggtctctccaacccacttcagcttgcaatccaccctcctgccctgtgaccatgtgtggtcacccgccctcagggcacaaaaggggtccagctctattttccagggacaactccagacccatgatcccagaagcttggggcctgcctttatcccagcacccaaccccgagagcccccagtgatggaactggtgcagcggccaccactgcccggacccgggagcaacaccgatgccacacctggcggcaggaacagggcagtgatgggctgtctgcaaggggtccccccttccgcagcaggtctcttggctgcagctcagccccagcccctgcggtccccagagtcccggtcactgggggctctgcaggccacccttccaggggcatccacccacccccgagtccgggtcaggcagaacccagggcccgccgtcccctcctgcaggctcaggacctcctggggggagttccctgtgtgatgcagagggcacgctcaccctgctgggaaggctcactgcttcccaaggggtctgagctttactggcacctcactgcagtcccttccccggggagactctggggcttcccctgtgggaccaggcacccggaaaggcagctctgtccctgctgagtcacgcgcaccatcctgcagacgggagggcatcttcctaggctttcctccagccaagagtggagctgggacctgggaacctccctggaaccacccctgctctccggcaaggcgttccaccagcctgtgtctacacacgtagccccgcagagcaggcttcgtgatgcctggagacacccacttccccttccttctcctgggacttctcagtcacacgggctgagctgcagagggtgcgtgacctgggctgagctggtctttggcaactggggactttggtttgacggttggtggaggggagactctcctaacttccaggggtgtgagtcgcaggcggtgcagatgataggacagtggccgttgcctagggctgaaaccaacacagcggtgggcggagcacagggaacttcggagagggagcccggcccccgagtcagctgctcctgcgggtgctccccaaatcatctagtgatgtgatccatttgtctttccagcccatttcagttgagtttccaatgacttacaaccaataatatctcaactgatacttgggctcttcaagcactagaattgtggtgacggcaggagcgttaacacactctggggcggggcagggactgcagactgagcgggctccaggtgaatgccagcttccagccctgctgagccaggctgggacgaacatgctcactaggtccgtctccacctactgtgggccagcgctgcgtggctcactccagggaagacagcaagttggctcagccgctgctgtgtggctgctgctcccctgagtttatggctgtccatggcatctgccagggtccatctggttttttgtgggaattgtgcccgtgaatttaacaaggattgatgggcattgccatcttgtctttttttttttttttagacagagtctcactctgtcgccgaggctggagtgcagtggcacgatctcggctcactgcaacctctgtctcctgggttcacacgattctcctgcctcagcctcccgagtagctggtattataggcgcccaccaccacacccggctaatttgtgtctttttagtagagacggggtttcaccatgttggccaggctggtctcgaactcctgacgtgggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccatctgcttcggcctcccaaagtgctgagattacaggtgtgagctaccacacccagctgcacccatacagttttttaagtcaacaaggagtctcgtttgcctcctcttgttaggaaaagaaatgtacccacaccctcaataccacaggctgtgtcctctaagtcttcccagacacgaagagcccttcccacctctccctacttcttcctccagcttagggacccccagggcctcacactgcccccccaccccccgaccctgcacacatagccccaggctttcctggatgtgccagcagttccaagaggccaggggcctgctgtccccctggaagcacaataaacggttctgcagctcattcagcctcactgcctcctggggccctgccaaggagctgggtgcccaattctgacccagaaggaattttccattaaaaatcaagtatctgtgcacaacctatgacccagccattctgctcctaggtacacacacccaagatgcgtacaaggacagctggagaatttcactcgtaattacccaaagggaagagccaccgcagaagggtagcaatgcacacctggcctattcccataagggaatcagcagccagagggggcaccacagcccccacgcagagacggacaccaagcacaagagcaggacctgaggggccacagacaggccctgggacacatggaatgggaggaagctgcagagggccgaggcatggacataactggagccggggccaggacggtgcctgtgagggcaggaaggagccatccacggagagggctggaggtcaagcaagctctgaaccaagaggtcaccatggagccacaataaggcctccaacaacctcagcggggcggcctagcatagtgaggcacacagctgaggggggagggcaggaagtgtggctggcaggcagctcagccctagctcaggcctggtgggcagcaggctggtgtctggctaagcagagggaaccctgaggcacaacatccatgcatggggtccctgaggtggtggatgtggagggacccaggaccatagtgggtgagagtgagcaggggacaatggcacaggcccagagaagcgccgggggcagccggaaaagacccagcacacggcagacggccacctgaggtggcagcccctgagccagcaggagactgacacctcagctgcccaggtaaaggggagtggcggcctgaccgaggccgaccacaggtgaagggtgggagggaggggctccattcagcccagagagacagccccacttcagaggtctcgagaccccatccagcccggccccctgccttcatcccacctgggccaccaccagggtgacagcagtaagggagggtcaggcgatgcctcggtcccgttttccttccctctttctgtcagaatcaagaccgagcatgccgatgtcccggccacggccccgtactcctcagtcgctacaccacaccccactgcctctgagagttttctttcatagttttcatattttaacatctttgaaactgggctgcgcctgacaattgctaacacgtcagaatttaaccaatggtggtttttatttctcaatgtactgtaaaatatagcgcagctcacaatggctggggtctcacatgggaggaccctcgatgacactctcctggcccaggaccacccttccagagcccctcaggctacatggtctttaggtgttttctccccttcccctcaaagtcttccacatcccacgccaccccaccccacccagtgctgggacaacctccagttccagacacccagcatcaggacaggtggacacagatgtctacatgatcttcctgaaaccctatccccaagtcacttagcactagggtgtcacccaggccctctgctgccatcaagcccactgtccagtcccaacttgttttaccaggtgtcacctgctgctccactcctgccccaacagcctttgccacaggactacctgccaccagccacacagagcacaggccacctgcaagtctgtgcattctgcaggacgtgactgcctgcttccgtggccgtccagcctacagggcctggcctactgggctgcaggtattcccctgctctggggccccgggcaagctcctctgagcctcagcatcctcattcaaagtgatgcagcccacaggtaggctcgcctgctccaatagggacggaagcacagccatggaaagccagcagctcagtgaggtctctgtggctccttatccaatacgatgatggacaggacaagcatgtgctgtatggttcaactggatgctgttaagaatgaaaggggctggggccaggcgtggtggctcacgcctgtaatcccagcacgttgggaggctgaggtgggcagatcacctaaggtcaggagttcgagaccagcctggccagcatggtgaaaccccgtctctactaaaaatacaaaaagtagccaggcgtggtggcagtcgcctgtaatcccagctactcaggaggctgcggcaggagaatcgcttgaacccgggaggcagaggttgcagtgagccaagatcacgccattgcactccagcttgggggacaagagtgagacttcatctcaaaaaaagaaaaaagaaaggggctagatgtggtggtaatcctagcactttgggaggtcaggagttcaagactggcctgggcaacatagaaagagccccatctcgaccaggtgcggtgactcacgcctgtaatcctggcactctgggaggctgaggtgggcagatcataggaggtcaggagtttgagaccagcctgggcaacatggcaaaaccccattgctactaaaaaaaaaaaatacaaaaattaggccaggcgcagtggctcatgcctgtaatcccagcactttgggaggccaaggtggaaggatcatctgaggtcaggagttcgagaccagcctggccaacatacagtgaaaccccatctctactaaaaaaaaatacaaaaattagctgggcgtggtggcacatgcctgtagtcccagctacttgggaagctaaggcaggagaatcgcttgaacccaggaagcagaggttacagtgagccgagattgtgccactgcactccagcctgggcaacagagcaagactctgtctctcaaaaaaaaaaaaaaaaattagccaggcatggtggtatgcacctgtaattccagcttctcaggagtctgaggcaggagaatcgctttatacccaggaggcgcaggttgcagtgagcagagaccatgtcactgcactccagcttgggaaacagagacagagcaagactctatctcaaaacaaacaacaaacaaacaaacaaaaaagggccccatctctgctctctgccctcaaaaaaaaaaaaaaaaaaaaagaacgaaagggatgctgttgattatcaagaatgaaacaactcttctgggtaaactggaatgtagagtcagcccactcttaggaaggtggaggcccagaaaagcactggggactgaaagaagagactgccaccagccacagcaaacacttgtcgggctaagggcagggcagccaccacgctgggcccttacacacattgcccacatccccacagctggaccagaaagataccctgagaacttccagttcagcgctgaaggagcctgccaccaagcagcggtgcccctcccagggcctccggggccacagcatttggggctcagcccgaatgctgcagctggcctgagcctcccaaagtctgcctccactctgcctgcaccctacagcaggtttctggactccctgaaagacccactccctactgatacccatgtggctttgctcagagactggccctccctccagatagggaggggagtcgcattgggtagaactatgtagaaccttcctcctccaggggacccaagggctttagagacttccaggtggggaggggacagaaccccagtctctggcctcccagtcccaaattctttcccccacacagccacatgcctaagaacaggccatgaggtaacactccagcaacgtgacaatagtgaggttccagagttagaatcagtgacgccatcgctagtcaccatgctcctccggagtttctgagattcaaagtttctaagactccactttctcttcgtgttctgtgtctttttcagccaacgaggctagaaaatgatctattgcccaagcaggcgcacgaggatacggctgtcacagctgccacactggcacctcgtggtcccttgaagaccgcccagggaaagcctctaagcgctgcaccacctcctcaccctctcccctgggtggtggcagcaacagcctgagcgtgtgcgccctcctccccatcctgatcccactcaaaccacaacctcccctgactcgccccaaatccagccctgttggctcttccttcacgtcccacttcccaccctctctacacgttctcgccacatcccacccaaagtccactcactggtccctgtttacacctcagggcctttggtcaagctgtcttctctgcccaaaactatcctactcatccttggggatccagctgaaagaccaccttcctgcgacggctacccaggggcaggagggagagaagcacagcccgtgccccgtatggctcccgcccccgcggtcacaaccaccgcccagtgagtgcctagaaggcaggcggaggccccgttctccccgttaggcccagcatcaccgcccggggagacgggaaagagggcaaggccgaaaaatggacagaaaaagaatgcggacggccgggcccgcggcgctccgagaatcggaggcatcctcaggcacggtccctccaggagaccgggaaagcggggctctgtcagccccaaagccccgacggcggcagaaggctggcccgctgcgagcgtccggcggcgctgggtccccggcacctgcccctgcctgggcgggaaaggcgctcagtccgagccgcgccctccccacgcgcgctcccaggcgccccgcgggccgcgccctcctgcaggtgccgggcggggaacgcgggcccctccctcggaccccggctgcccggccactcccccgcgcccggccccgcccggccctgcagggcacccgcggccgcgcggcgacaccagggcggggcccagccgcgcccgccccgccccgccccgtccccgccgcccggcgccgcacccgcctcacctcgccccgacccgccgccaccgcctcttccagctgggaggccccgccggaagtgacgccaccgcgggctgcacaggcgcaggcgcagcgcgctctcacgtgaccgcccggctggcggagggcgggggcggccgggattcccgtgcggggttggggctcgtggcggaagctccggacctccctggcccgaacggtgagcgccgccggccactgggagcggccagagcccagtaatcaggacaccaccacagggaccacgtgtgtagacccaggccccctcacctgggagtcacgtttattgaaaaagtaaaaagtgtcacagtaaaaaattcacctggggacaaagccaggcctaggaggggtggcggggtcgtggagggacgggtccggccgcccctggcccacgggtggggcacgtgctggcccatgggcgacgcgcggcttctccagggaggcggccctgggcgcgggggcgggcgggcaaagctggctcagtccatcgtggtccctttgaagagctccaccagctccttgtagtccgggtcgatgaggtcggagggcaggtcgccatcgtcgttggttgcatccctgtccgctcccagggagataaggtacctggggtgtaaaggtcgctctggctgaagcggggaggagccaggagagtgctcgccccaacccgggtcagagggccagagtcctggggtcacctgtgtgtcccccaccttggggtcctaaggtccgggtagggtgaggaggaagaaacctgaccctttggaagctgtggccagcttttcaagttggttctattgaggacaaaggcagaaacaggattccagaagcctctagggtttgcagggttctttttttgttttttttgttttttgagacagaatttcgctcttatcacccaggctggagtgcaatggcatgatctcgactcacggcaacctccacttcccgggttcaagtgattctcctgcctcagccttgagtagctgggattacaggcgcgcgccaccacgcgtggctaattttgtatttttagtagtgagagggttcttgtcacgaactcctgacctcaggtgatccgcccacctcggcctcccaaagtgctgggattacaggcgcaggcgtgagccaccgcccccagcctctagggttcttgccgacaccacccgggctacattttggggctcccatcctggggacccactgaggcccggaggggtcgggttcaagcctgtgtagacccagggccccctcacctggctatgtcagggtacccatcgctgcaggcaatgtgcaggggtgtccagcccgcctcatctcgctggtgaatgtcagccccgtatttgaccagcagcttcacgcattccaggtttccagagagcacggcttcatgcaaggcggccaggcctgggcagggaggacgggaggggtcaagactgagccccaggtcaggtcctccttgctggcctctcccaccaccccacaggccctggccagctcttccaggctttgctcacctgaggggtggatggtggccagggagactttccgagtccggatgaagcgccccacctgctccaggtcaccctgccggatgtggtccaagaacaggacatcattagggaaacgcacgctgcgatcagccagcatccgccgccgccgctgccgtgggctgtagcgggcatagcgggcagttctgctaggcatcttgggcgctgtggggcaggttgcccctggggaccctactgcactggggttaataatgtatccggtcccgaccagatcagcttgagggctcctgtcggacgagccccggcctctgacttgcttatatagggctcaggggctatataaagctgcacggtcatcctccccggcgcgaggggctgaaactgagctgcacccccgccccgcaccccagatcatgtttagtgactcatctttcagcccatctgtcaccgtgcccggccaaaggggtcagatcattcctgcctgtcgctccctgccccacagctggacctagaaggtgccttaccgagggcaggaggaggcaccggtgcagaacccatgagatagctaggaacgcgagatcaagggcacagtaggtaccaaggtcattggaagggcttttgctctctacctcctggaaagtgaggggcggccaccccctccacatctgcagaagcacaggtccaccgtgctgtggtgaaacaggccttagcccctccatctccctacctgtcagttttcaccttccagcgtggcttgcctcactctcagtggttttcccaaaactactctgatggcctaggcaggcggatcatgaggtcaggagatcgagaccatcctggctaacacggtgaaaccccgtctctactaaatatacaaaaaattagccgggcgtgatggcgggcgcctatagtcccagctacttgggaggctggggcaggagaatggcgtgaacccgggaggcggaggttgcagtgagccgagatcgtgccactgcactccagcctgggcgacagagcaagactctgtctcaaaaaaaaaaaaaaaaaaaaaaaaatgactctgatggtgctgcctcctgctcagaaaccccgcaggcatccttggctgggatctcagtgcctcaggctcctgctcagtcagtcctgcgacttttcctccacgtgcctggctcccctgcctcacacacctgcaggggacagggtattccctacacactcatgggttcaccctgcatagtgtctctgcattccaggtttgacacacatactcacacttaaggtggtgtccagtttgctctccacgttcagggaccatcacaccctgggtggtgtgctctctctgccccggcccctgtgatcttacctctagaagcacagccaagggaatttttttgtttgtttgtttgagtcagagtctcactctgtcgcccaagctggactacattggcgcaacctcggttcactgcaacctctgcgtcccgggttcaagtaattattttgcctcaccttctcgagtagctgggactacaggggcatgcaccaccacgtctggctaatttttgtatttttagtagagacggggtttcaccatattggccaggctggtctcaaactcctggccttgtgatccgcccgcctcggcctcccaaagtgctgggattacagacgtgagccactgcgcccagccaagggaatttttaaaactcgtgttccaacaggctcttcattgctggctgcctttacttttgcaacagccccagtggaggtccaaagtagggcttggactacaggacatgagcaagtggatgggatgggacacagacacagagttgaccagggaggtctttgttgtcagggacagcgatcgattgtgctaggagcactgcagcacttgaagctggatggatgagtctgccggggctgtcttcacagaccacagactgagtggcttaaaaaacagatggttggccaggcgtggtggctcaaccctgtaatcccagcactttgggaggccgaggcaggtggatcacctgaggtcaggtgttcgagaccagcctgaccaacaaggtgaaaccccttctctactaaaaaatacaaaaattaggccgggcacggtggctcatgcctgtaatcccagcactttgagaagccgaggcgggtggatcacgaggtcaggagattgagaccatcctggctaacacagtgaaaccccgtctctactaaaaatacaaaaaaaaaaaaaaaaaattagccgggcgtggtggcgggcgcctgtagtcccagctactcaggaggctgaagcaggagaatggcgtgaacccgggaggtggagcttgcagtgagccgagatcgtgccactgcactccagcctgggtgacagagcaagactccatctcaaaaaaaaaggccaagcgcgttggcttacgcctgtaatcccaacactttgggaggccaaggcaggtggatcacgaggtcaggagatcgagaccatctggctaacacggtgaaaccccatctctactaaaaaatacaaaaaattttctgggcatggtggcaggcgcctatagtcccagctacttgggaggctgaggcaggagaatggcgtgaacctgggaggcagagcttgcagtgagccaagatcgcgccactgcactccagcctgggcgacagagcgagactctgtctcgggaaaaaaaaatacaaaaattagctgggtgtggtggcaggcgcctctagtcccagctactcgggaggctgaggcaggagaattgcttgaacccaggaggtggaggttgcagtgaactgacatcacaccactgcactacagcctggggatggagcaagactccgtctcaaaaaaaaaaaaaaaaaaaagacggtccgtcccagagctctggaggctgaaatctgggatccgggtttcagcagggcaggttcctcctgaggctctgaggagcgtctgtcgcaagcctctccccagcttctggtgccgccagcaatcctggtgtccttggccctagcagcatcgccacgatctcggccttcatctccatggtgttctcccagcctttgtcactgttcacatcacccccttgtataaggacaccagttatagttgggtattgcctcatcttaaccagtgacatctgcaagcatcctgtttccaaacaacggtcacattctgaggtcttgagggctaggacttcaacgttaattaaggagacacatgagtcaacccataatgctggtaaaaccctgcaggtggtcactaaaggcctgaatgaggacagaaccaagactggccagcagctctttgcaggggcagaggagagctgggccaccaacagcctcgcatcattaggctgatctgcatccaacgaaatcaaatcagcaaacatattagacacctctaggtgcaaagccttggccaaatgctatgggagggctgggcacagtggctcatgcctgtaatcccagcactttgggaagccaaggctggagggtcagttgaagcgaggggtttaagcagcctgggcaacatagtgagactcctttgctttaaaaaaatttaaaactggccgggtgcagtggctcacacctgtaatcccagcactttgggaggccgaggagggtggatcacgtgaggccaggagttcgagatcagtctggacaacatggagaaaccccccgtctctgctaaaaatacaaaaattagccggatgtggcggcgtgcgcctgtaatcccagctactcaggaggctgaggcagtagaatctcttgaacccgggaggcggaggttgcagtgagccaagatcgcgcgactgcactccagcctgggcgacagagcaagactccatcttaaaaataataataataaaaaatttaaaaaataaaataaaaagagtaaaaggaaaaatgctgctggagaagcggcgctgacggagggtccctgcctggcgaaatttcctggacctgcgttggtacccaggtgcaccccctgtcccctcccctgccccctgggcccctcgcctcgggtacaccacctctccagtcacacactggagtggccctggagcctctagccaggcccgggcctgcagacaccctgaggggggtcggctcccagcgtggctgcatttctagggactcagggaaaggtatggacagttggaattccaggtcacttgggaggagccaggccgttttttctggcttgtttacgtgaagcctggagacgaaacgttgtacactggagacaggctctcctctgatgtgaagattgccttttctcatgttgtggaaagttctgtctgccctcccccctcagaggatcagatgaaagcacgctggatgaagctgccaccaacagtgtgacgagaaggaacgccctttccaggagtgaccgggcctcaggctagagacgcggtgggggcaagaccacccggtgagcctgtttggcgaccccaagcaagcccctgtgtccctcctgctggaggtgagctgggagcgtgcagagcttttggctttggggtttctatctggatcacccgagggactggtgcctgaagcctcgccagtcacaacagatttccttgaaaggtatttatgtgccttctattctaataaggatgtgggaaccgtgtgttctacgccatgatagacactccctggagctcctcacccttgaaacgttccatcagaagccggccgtcagcagtcgtgcctgctccaccgtgggcgaagcgtgctgttcatgcagcgtgacgtcagagccaaacctgtcttcatggagttttgtccctgattcttcttggtccatatgaacttgcaaattgacctagtttgcatgactctaagtttctgccttctggaggacgaactagaacatctgatgcacaaggtttaccatcacactttttttatttttttttgagacggagtctcgctccgtcgcccaggctggactgcagtggtgcgatctgggctcacggcaagcttcgcctcccgggttcacgccattctcccgcctcagcctccggggtagctgggactacaggcgcccgccaccacgtccagctaattttttgtatttttagtagagacggggtttcactgtgttagccaggatggtctctatctcctgaccccgtgatccgcccgcgtcggcctcccagagtgctgggattacaggcgtgagccaccgcgcccggcctacccgtccaacttttagaagtccagtgaggcctggctgggctcagaagctcacgcctgtaatcccagcactttgggaggccaaggtagaaggatcacttgaagccaggagttgaagaccagcctgggcaacatagggagacccccttcccttcaaaaaatttaaaaattagccaggcatggtactgggtgcctatggtcccagctacttagaatgctgaggtgcaaaagattgcttgagcccaggagtttgaggctgcagtgagctacagtcacaccactgcaccccagcctgggcaacagagcaagaccctgtctcaaaaaaaaaaaaatgtccagtgaatgcaaccagcagtgctctgcaaaagcacccgggagaccctgttagtaaagtcagctgaggccaggcgcagtggctcacgcctgtaatcccagtactctgggaggccaaggtgggtggatcacccgagatcaggagttcgagaccagcctggccaacatggtgaaaccccatctctactgaaaatacaaagattagccgggcatggtggtgcatgcttgtaatcgcagctactcaggaggctgaggcaggagaatcacctgagcccaggaggcagaggttgcagggagctgagatcgcagcgctgactccagcctgggcaacagagtgagactatgtctcaaaaaaaaaaaaggaaaagtcagcgcaggtcgcactgcagtctggcaggagggccagcctagggccagaagggcccttccctccctgaggtcagaggccccccggggtgtggtacatagacccagcaatcactgttttaggctccaggccggtggcttcctggcacctggagagacagagggttgggaagtcccaggctgctaagccctaaccacctcctcccagagccttcaaagtctccccactaatccagcagcccagtcagagaggttttggacactgccccaccacctcccagccacagccgagcccaggaatgtgctcatcagctgcctctgcaaaacgggaaaggtatcagtgactccctcccctttccagagcacatgacaccagtgctgcgggcagctgtgccatgtcccaacgttctctccagagggccggctccccgcacagctggtccacagggtcactgcaccccatcccacggccagggagcacaggcacaaatacagcccacccctttagctgtgactcaggacagcctccctcagagaccctgcaaggagccacagccctcgggcctctgcccacatcctcccacggcacctccagatgccgttgcccacttttccgtgagtacgcggctcactgtgtcgcaggacccaggcatggcacacaaaccctgctgaggccctggagctgaactagccagaaaccagccccagcacgggctgtctccaagacgcacagagctgggggccggggcagacggcagcacccagactgccgagctggtgtgagccgtgtggggccaaggacatgtgggcaaaccgggctggctggtgctggcgacgtgttgacacaggtcctcgcggcatgctggccggatactccacagcctggagcagaggcaggaggagccggagcggccgagtttgtgagggcctgtggggccggcaagggaggtagcggggagaacgggagaaccgcacccccggcgaggcctggtctggcttgagagccgtctctggctccagcagctgcagccagcccgcaagctcgggaactgggaggacacccgggaatctcggcagtgcggaagctcctactctaggaagcacatcaggatgtgaagttggcggggctcacagagtcacaggcagggctcctcaaggcagcctggtgagggtcgtttgttccatccgaacttctgagggccgagcagcctccctagagctgcagctccacccccactcccacctgccacctgcacccttgggctccttcctcctgcctcaccgccctctgagaccaccatgagccctgctggatcctcagggcctctgccgttgccctcagggggacccacagacaccacagagctcctgttgcctcccctgcagaaaagcagcaaatccaggctcagcagagccatcgcccagccctgcacacaggccgcggcttgccgtctgcagaaaaattgactttcagccgggcgcggtggctcacgcctataatcccagcactttgggaggccgacgcgggcaaatcacgaggtcagccagcagatcctggctaacacagtgaaaccccatctctactaaaagtacaaaaaattagccgggcgtggtggcggatgtctgtaatcccagctactcaggaggctcaggcaggagaatcacttgaacccgggaggcggaggttgcagtgagccaagacagcaccattgcactccagcctgggccacagagcaagactccgtctcaaaaaaaatcgagtgtatgtgttttttctgcatgtgaagcacaggagtgctgaggttaagccaaattacaacttaaagaccaggagatccttatttttagagacagctctgtcacccagctggagtgcagtggcgcgatctccgctcactgcagtgttgacctcctgggatcaagtgatcctcctgcctcagcctcccgagtagctgggactgtaggtgcaaaccatgcccagctaatttctaatttttcctagagacggggtctccccgtgttgccccagcactgggattccaggcgcgcgtccctgcgcccagccctgccctttatcgtgtgaagggttagtgataagcagggccccctgttcctctcacccatccttgaagcctgagtccacctgatttctcgtcactccacggcggggatgggagggaatgaccaggagtctgagcatcacatggggctgggtggctccacccgtgtccacatccagggtccagaatcacagaagccccatcagagtccaggtaaagcagcctacaggcagggaaggcatcctccccgggaatcgcaagcctgcacagctctgctggggagactggggcctgtttctgcatctgcacctcgtcccaggggcgaggcctctcagcaccagtaaccccactaaggcctggcagatggccttggcgtccgcattccagcccagctctccgggcttggtgagatcataaacccgaggcaaggacaggtggtaaaatttcaactttatttggccaatgtgttcaattcgattgtgaaatagaaatgcctgaagaactgtcagcgtctgattcagctccagcatccttggccacctccccacccgggagtcaagggtcgtggttctgccttgaacaggccacaggccgtgctgtagagaggccagtggtcacaatgagcccacgacaggaggaggagccctggcttgagggaaggggaaggcccaggcctgtgccgggccccagggctggcagccaccagctcctcttccaggcatgggggacaccctgacaggatccggaagtctccatttacccaaaaatgcaagagccatgatcagtcatggcgacactgcaggcggtactgagtgaccatgtccagtccggctccgtccctcccacacgggggacaagcttctccgaggaggcctggccaaggtggaacaaataccctgatgtcgaaaaatgtctaaaaatcccacagacggaattttcaaaaagaggagaaacctcccgcgggagggaggcagcgagactccgaacacggtagcaagcactctggacagactcatgtatgaaaaagtacatcatggtttcaggaaacaagccccaccagggtgggctgcctggagatggatccctttccaaaaaccgaaaagcagaaggaagagacgggggtgaacggacggtgtgtaggggtgaggtgtcacttcagagaggttccctgggtttccggcgacgccctccttcaagcgaggccgcaggcttcggaggcgtgcgctgctgctgggtgtgcagcccccgaggggtctcggcagcgcccgggtctggctttgcgtattacagttcatctttcacagctttctgatcatcgtcttcctccatgtctggctcctctgcttcttccaggtcctcgagatcctgggatacaggaaaaggggcggggcgggcaggttggctgcaacagctgaggctgccggcccccagcaccccacactgctcacaccggggactagccggccacggcggacatggccaccggccactggagcagccaaccctggtctttacgagctacacaggggtcttcccaggaagagtgacgcctgggggatttctgcctatagcaggatgaatcagagcccccactgtgtcaggaaccctgggaatcccagctcagccttggacccttccactgggcatggaaggcgtatgtgtgtctcccagcttggcaccatggagtctacagagggtccacatctcggcagggacaacagccccagcatgaagtccaggcacagtcaccactggggtgtgaccattctacttccaacccttgggctctggccaatgacaggccacaggcagcaccaggggccggccctccatccccagcctgggcagagtattcccacctcccactgtgcaccagcactcccagcaggccctgccagcctgggctgaccatgccctcatctccttcaccatggtcaagcaccccgcccctgccgcatcctcccaacaccagccttcctgcttccccggcagagtcaccactgctgctggccacgcgctgacgggcaggactaaactcccgagggcagacccatgtctgcgcccttgtgcccgggccccgccagcgggctggggatggacctctgagtccaagttagcagcatgtgaggaaccggtgccatgtgtctgaaaaggttttctaagcaaaatctggtttttaaagatgccttcaacgtcgtcccctaaagaagtgctggccagggagagctgtttcagcagagcactgggagcacatcccttgccctgctgggcgaaggtgtggagccccagagccctggacgcacagacgtgcctccaatggcaccattcccatcacaagccgagcccaagtgggcatgtcccgtggggccaaggggctgaatcccagagaccagcccagggctgtgaccccactcacgtcatcatcccctgccccatcctggccaccgctctccaggaatttcttaaaaccatccagcgtgcgttccccgttgtaatcaatgacctgtggaagacagggatgagtgcaggggctggtcccggcccagagccaatctcctggcattggctcctcctccctagagaaaggcagagcaggcccggtccggtggctcacacccggaatccagcacattgggagttcaaaaacagcctaggcaatatagtgagatcccatctctctcgaaaaacaaaggtgggtgcttctgaaggagctcccacagctcttctcccacctgactagccccaggctccttccagagaggcacccaggctggcgtggggaccactgctcttcccagagcccgccccagccccgtctggagggaaggcgcaccgtcctgtcggcactggcaggaaagaacttgagtgtggggaagctgtgcactttgacggcctccacctcgttggcagtcgagtccatcttggcgatgacgatgttctcatggtccttgtacgtctctcccagtttatcccaaatgggagccaactgtttgcagtgaccacaccatggggcatctgaaaagaaagcagttctagggtgtgtcctggacacaaagccactggcagacgcttccccaggagtctgcctaccttgcgcgtgccctggtggcacggacctggggagctgaaagggcaacacttacagaactccacaaagacgttttttttctcatcaaaagccacgtcttcaaagttcttcccaacaagcaccttgacaggctgcttgtcccagtcctccggcagctcctggctcatcaggtggggctggagggcaggcagggcacggtgaggggcggcgatgcctgggggaccacagagctccccaaccctcaccctgcccgggactgaggtgcgtggctgccctgggcacaccagggtggcagccgcagacaccaacagtgccaagaatccagaaagagaaggctgggccagtgggctgggcccaatgagcccacgcaggccgcaccctcgccggccaggaggtttccctgaggagcatctgggccagccgtgtggacaagagggctcctacaggtccccaaaggtgtgacaagaatggtggtcttcacaccatcttgggctccgtcctcttactctgaagatcttactttgaggacgaagcccaggacactgagagcccagagaccccaaggtggcggctctacccgggaggcagccctggcccggggacgcgcctgcaccttgattttgccctccaggaagcggtggcagaactctgtgatcctctctgccgtcagctcctccgattcgggcttgtacttggtcatctcctcctccagggtgatgaggcgcacggccgggcactcttccttcttcaggccaaagaactcgaggatgcgctggttgtcggtgtggtcgctgtcgatgaagatgaacaggatctgggggagaaaaggaggttgcacaggtgcgggagacggctggcctctgcctccagccctgactttgctcggaagcagaccgtgctccggtgcctttttcctccaacctggattccggggttgcccaaccagaccagcaggtgactgggagcagaggtctggcctggctggcccctcgcctacatccaggctgtcctgaatcaggtgcccgatccagtccagcaggcagcctcaggaaggccccacacttgtcacctcgggaagagttgtactgctccctggcaccgccccacgagccacccagaagagcagctcaccttgcccttgaagctctcggctgctgttttgaagttgctcagtttgccgtcatagtcagacacactcttgggcaagaacagcaggatgtgagtcttgatttcacctccaaaaatcttcggggctgtctgtgttataaacttaagttactgggtctgagtcacacactattaatgcagaagattctcccaatggcctccaatgtcagacgctggacagcagtggtgaccgggagcctcatgccacccccaacccactcctccccatccccagcctgggggctgcagggcagccgcacctgctcggtgaactcgatgacaaggggcagctggttgtgtttgataaagtccagcaggttctccttggtgacctccccttcaaagttgttccggccttcatcaaactgtggacagaaagagggccctgactgagcattgctgctgggagcacagcccctgggcccgggtctccctggacgtgggaagtcacagcagccagcagccctgccctcccgtggggtttcgagccacaggtccagcaatgggtacaggacatggctgttcctcgacagtaagactggctctggtcacggccttatggctgcccgtgaattcaacagctggcttcacatccacaatgcaagcctggcgcacgtggtcctccagcaaccttgaagtgtggcccatccccagggcccctagccttttcagggcacccatgtggtcaaagctattttcttttttatttgtttttgagacagtctcgctctgttgcccaggctggagtgcagtggcatgatcttggctcactgcaacctctgcctcccaggttcaagtgattttcctgccttagcctcccgagtagctaggactacaggcgcctgccaccatgcctggctaatttttttttgtatttttagtcgagatggggtattaccatgttggccacgaaggtcttgatctttttttttttttttttgtgatggagtcttgctgtgtctcccaggctggagtgcagtggcgtgatctccactcactgcaagctccgcctcccggattcaagccattctcctgcctcagcctcccaagtagctgggactataggcgcccgccaccaccggctaatttttggtatttttagtagagatgggtttcaccacgttagccaggatggtctcaatctccttacctcgtgatctgcccgcctcggcctcccaaagtgctgggattataggcgtgagccaccgcgcccggctggtcaaagctattttcacactcacacttctctggcctctgccttttcactctccctctcacgtgctgcggcacagacccacagaggctgctgggcgcatggtgtcgcaagagcaggagggcaggagaggagaatcctgctggaggaatctaaaacatcactcagcactaaattgtttttgtctgggacaaactagtttccgtaaagatgtgatttatgataacatgtaatgggattattattcttttaaaataaatttggctacagtggctcaggcctgtaagcccagcactttgggaggccaagatgggtggatcgcttgagaccaggagttcgagaccagcctggccaacacggtaaaaccccatctctactaaaaatacaaaaataagctgggcgtggtggcgggcacctgtaatcccaggtacttgggaggctgaggcaggagaatcgcttggacccgggaggcggaggttgcggtgagccgagatcgcaccactgcactccagcctgggcgacaagagcgaaactctgtctcaaaaaaaaaaaaaaaaaaaaaaaaaaggccaggtgcagtggctcacacctgtaatcctagcagtttgggaggctgaggcaggtggatcacttgagttcacgagtttgggaccagcctggccaacatggtgaaacctcgactctaccaaaaatacaaaaatttagctgggtgtggtggtgcacacctgtaatcccagctgctcgggagactgaggcagaagaaacacttgaacccgggaggcagaggttgcagtgagccaagatcgtgccactgcactccagcctgggcaacagagcaagactctgtctcaaaaaaaaaaaaaaatacaaaaatacaaaaatcagttgggtatggtggcacctgcctgtaatcccagctacttgggaggctgaggcaggaggattgcttgagtctgggaggtagacattgcagtgagatcgcaccactgcactccagcctgggtgacgagtgaaacaggccaggcgtggtggctcacgcctgtaatcctagtactttgggaggctgaggcgggcggatcacctgaagccaggagtttcagagcagcctaatccaacatggtaaaacgtcgtctttactagaaatacaaaaattagctgggcgtggtggcgggtgcctgtaatcccaactacttgggaggctgaggcaggagaatcgcttgaacccaggaggcggaggttgcagtgagcccagatcgtgccactgcattcgagcctggcaacagagcaagacttcatctcaaaaaataaaaaataaaaataaatagagagaaaaaaacgattttttacattcttagttctagtttctaatacaacagatcctgaaaggcgcaatccacgtgcctgtaaggccctggggacccctaataatgcacggcagcttcagggagtcctaaggccacaagatggagaggctgtggcgccccaaccacgaggggtcagcctgcagctgaggatgcggcctcggctcaggctcagagaggcgcccctgtgctgaggctcttcaagtgagaattttgggtgagccttccatcattcccccgaactacttttttatttatttttaaaatttatttatttttttattttttgagacggagttttgctattgtcacccaggctggagtgcaatggcatgatctcggctcactgcaacctccacctcccgagttccagcaattctctttcctcagcctcccgagtagctgggatcacaggcacccgccaccacgcctggctaatttttgtatttttagtagagacagggttttaccatgttggccaggctggtcttgaactcctgaccccaggtgatccacttgcctcggcctcctaaagtgctgggattataagtgtgagccactgagcccggcccaaactattttattttttttttgagacggagtttcactcttgttgcccaggctagagtgcagtggcaggatcttggctcactgcaacctctgcctcccgggttaaagcaattctcctgcctctgcctcccaagtagctgggattacaggtacgcgccaccacgcctggctaattttgtttttttagtagagatggagtttctttctccatgttggtcaggctggtcttgaactcccgacctcaggtgatcggcctgcttcggcctcccaaagtgctggaattacaggtgtgagccactgcacctggacagaactactttttaaaatacttatttatttaatttattttattttattttatctattttgagactgagttttgctcttgtttccctggctagagtgcaatggcacgatctcgatcttgcctcattgcaatctccgcctcttgggttcaagtaattctcctgcctcagcctcgcaagtagctgggattataggcatgtgccaacacgcctggcaaattttgtatttttattagagatggggtttctccatgttggtcaggctggtctcaagctcctgacttcaggtgatctgcccgccttggcctcccaaagtgctgagattacaggcgtgagccagcgtgtccagccaaaaaaatttattttatttttactttttgtagagacagtcttactatgttgcccaggctggtctcagactcctggcctcaagcaatcctcttgtcctggcctccctaagtgctgggatcacaggtgtgagccaccaagcctggtccccttgaaccttttttttttttgagacagagtcttgctctgtcgcctacgctggagtgcagtggtgcttctcggctcactgcaagctccgcctcctgagttcacgccattctcctgcctcagcctcctgagtagctgggactacaggtgcccgccaccacgcccggctaattttttgtatttttagtagagacggggtttcaccgtgttagccaggatggtctcgatctcctgacctcgtgacccgcccacctcagcctcccaaagtgctgggattacaggcatgagcccctgcacccggcctcctcaaacttcttaaatgagacttggggaaataaatcacgcatcctttcttactggccgtttccatgtatgcgtctgcagagtaacttagagaccaggtgccactccctgctcttgtgcacgctgtgcctgggccaccctggcctggcctgactgccaaggagctgatgttaaaccagggcacaagcaccaaccaccctgcccgaacccgaggggcagaggcttctaagcctgctacctcttccccagaggggcaaaggcgggtaaggagaggcagaaaagccaagttcaggaggcccttggagggaatcctttggaacatgagctgctgatcacagccgtgctcccagtggcacgggtgggctcgcactgtgcccaggagtaacgccgggccgcaactgcaggcaaacgaaatccccccacccctgcagaacaatgtctctgactccctccagagtgtcaggcgccgcctacaccatctcatgccaagaagccaggaggagacactgccgcagctgtcccagggctgccatcgtttcagcagagatgctacaccacactcaatcacggtctactgcggtaagggaaactggtccacttagcagggcacagcagcaggaggccagccctgccaggccacggtgacaaacagcatagaaacgcccaatgcaggccgggtggtatggctcacgcctgtaaccccaatgttttggcaggctgaggcaggaggattgcttgagctcagaagttcgagaccagcctgggcaacacggtgaaaccccatttccacagaagtattaaaaaatagccaggtgcggtggtgcacacctgtggtcccagctactcagcaggctggggtgggaggactgcttgagcccaggaggtcgaagctgcagtgaagtgtgattgtgccaccgcactccagcctggtaacagagcgagaccctttctcaaacaacaataacaggcccagtgctgccagctgggggagaagaaaaagtgaaatatcagaagctctcacacccatggtgccagtgaccagcagcccccgcagaggttttcctgggttgcagtgcctgctagggaaggaagggaagagcaggcaagagcgggccacacaagagcacccgactcagccaggctgcccactgtggccactgcacacacaggaaggcctcactcactttgagggatgggggttaacagcctggtggaaaaggaacaagttggactcatcctctcagctgcggggtgagctctgacttccagggcagcccctaccacgtgcaccggacagggggccgggcttctgcccggagctgcctgcaacgaccacgttcgccatcacagacacctgagccaccttcagtgggcaggaaagcgccacccaccaactggcatcaaacccaagtgggtttgtctgtgcccagctctagtggactccagagaatggagacagaacgttaacctgtggggagcccacatggatggccacgtgtgagcctttgcaggcaagagcaacgaaaccaccctcccagccttcgcggacacatatcaccaaactgtccatagagtcacagcggccactgcagacatccagggcactgaaggagctgtgggctgtgtgacaacacagggttcgcgagtttcgtgggctctggagaaagtctgccccagaacccaagtttcaggacaagacttggaactttctctttaataaaagctctaaaaagacctttggttccttcaactttatccaacacttcactggctttttctagtcagaggtttaatttcctgggcaccttgcaatggcaatagactaatttagcaactctcttcccttcaggggacatcaagagaatgtctcctggtaaagagcatctactgtcttgagttatcttgaggaagtggctgcaaaaacagctaaatgacaagaacaagaacatggaagcaagccatcctgacccacccgcaccaccgcgctccaggaagctggctctaccctccctcctacctggtcccggggagtgctggatgctccgtgcttactacagaaagtgaatgggtcggtggctcacacctgtaatcccagcactttgggaggccaaggcaggcggatcatgaagtcaggagttcgagaccaccctggctaacacggtgaaaccccgtctctactaaaaatacaaaaaaattagctgggtgtggtggcgggtgccctgtagtcccagctactcgggaggctgaggcaggagaatggcgtgaacccgtgaggcggagcttgcagtgagctgagatcgcgccactgcactccagcctgggcgacagagacagactctgtctcaaaaaaagaaaaagaaaaaaaaaaagaaagtgaatgggttccttgtgtccaaaaccactcagccccaatcccagaggctgcccgtctgaccgtttggcttatgatgctgctgtctaaaaggttcttctcccctctggaaacgacacaggacaggagctgaaggtccgatcgcccccggccgccctcctgcccctcactccccaggtccctcctctcccgagactttctctcctatccacactaccctggctctgagcggcacaaacccaccatcacccacatccaggttcagctgtccctagagcacaagtgtgcggccccagccccacctgcctggtgaccgagaaaagagacaatagaaacccacaggccccatcttgacactgtgcaaacaaggaccctgctgtgtcctggtaacggggagaggcggctaagaggccacactgtccaggagcccttccccaggagaaggacagcgggatcaggatggcagttttcacagtggatccttaggggtcataatgcccttggggctgaggggcatacgaagtgtgggtgccacctgggtgggaacacgcccagagcgccaatactccagacctctgggtaaggaaaacgttctggaaatagggatgctgcaggacgctctgaatgtagttaatactttagaatagttaaaacgtggccgggcgcggtggctcacgcctgtgatcccaccattttgggaggctgaggcaggcagaccactcggagctcaggagttcaagaccagcctggacaacacagcaaaaccccatgtctaccaaaaaatacaaaaactcagcccagcgtggtggcacgcgcctgtagttccagctgctcgggaggctgaggttagaggatcacttgagcctgggaagcagaagttgcagtgagctaagaatgcaccaccgcactccagcctgggcggcagagtgagaaaccctatctcaaaaaaaaaaaaggcaaacggggccaggcgcggtggctcacatctgtaatcccagcactttgggaggctgaggtgggtggatcacgaggtcaagagattgataccatcctggccaaaatggtgaaatctcatctctactaaaacaaagattagctgggcatggtagtgcatgcctgtagtcccagctactcgggaggccgaggcaggagaatcacttgaacccaggaggcggagggtgcagtgagccgagatcacgcaactgcactccagcatgggtgacagagcaagactctcccaaaaaaaaaaaaagggcaaatgttgttacatgttttatcataattgaaaaaaaaaaaaaagctaacagtcaaaagcagttctgaggcggctgtggcaggagagtggccagaaggcccacagctgaatgcgaagaccaggccacaggcatcagcgcaacaccccaacttggcaaagctgcagaacatacctattgggccaaaggtgccaggagcaaggttcccttaacgataaggagagcaacgccaccctctgcagaccaaccccagaactaacctgggcagagctgcctggggccactcaccttcttaaagaggacaaccccatctttgtcgagctggtatttggagaacacgtcactgttggaagtgatcccaaatggtatgtcatcgatggcctctgctgcctgcaaaaactgcttggcagagtccgactccacgtcctgaatgaggagggagaagcagaggtcgtcatgatcccgcagcaccaagcagtagggcagaccctgtagagcccaggccaggggggacacgtgcagaactgccagctgcaggctgtggacccctcctcaatggatgacggaaggaaggaagactggaatgctctggtctctaccttgaagaagccgatgacagccacctcgctggactccaccaaggactctgcagctgcgccgtcaggcagggtggtggcagccgggcccgtgcgcttcttcagccagttcacgatgtcatcagcctctctgccagctaaccccaaacaaatgtaggttctactctcaaacagggagtgccgcctgccctgccgcgcctgctcccgtctctgctctctgccagccaggctgaggacacctgaatcaacctaagtaagatgttctcccaccatggaagaggcccggtgccgtccgcccgcctcctaaaccccagtgtacgtgagactgtggttgtgtttatggggagtggagagggaagagggtgattctgtctctgaataacaggatcacaaacccattttttttctctgatctctctgcattttcttttttcttttgacacaggggctcactctgttacccagctggagggtagtggcagaatcttggctcactgcagcctccacccactgggctcaagcaatcttcccaacctcagcctcctgagtatctggggtacagatgcacgctaccacacccagctcatttttgtatttattgtagagacggggttttgccacgttgcccaggctggtctttaactcctgtgctcaagcagtttgcccaccacgacttcccaaagtgctgggattacaggcatgagccaccaatcccagcccttttttttttcttggaagacagggtcttgctctgtcacccaggttagagtgcagtggcatgatcatggctcactgcaacctcgaacttctgggctcaagcaatcctcctacctcaggctcccaagtagctgggaccacaggcatgtgccaccacacccaactaacttttttttttttttttttttgaggcggagttttgctcttgttgctcaggctggagtgcaatagtgtgatctcggctcactgcaacctccacctcccgggttcaagcaattctcctgcctgaccctcccgcgtagctaggattataggtgcccgccaccacacccggctaatttttgtatgtttagcagagacagggttccccatgttggccaggctggtctcactcctgacctcaggtgatacacctgcctcagcggtctcccaaagtgctaggattacagaggtgagccactgcgcccagcaatgtttcttcttttttttttttttttttgagacggaatctacctctgtcgtccaggctggagaatgcagtggcgccatcctggctcactgcaacctccatctcccaggttcaagtgattctcctgcctcggcctcccaaatagctggtattacaggcgcccgccaccatgcccagctaatttttgtatttttagtagagacggggtttcactgtgttggccaggctggtcttgaactcctgacctcgtgatccgcccgcctcggcctcccaaagtgctgggattacatgcgtgagccaccatgcccggccaatttttctattttttgtagagatggggttttgccacgttgcctaggatggtctcaaactcctgggattaagcagtccgcccacctcggccttccaaagtgctgggattaccgggatgaaccactgtgcccagccctagctaatttttgtattttttgtagacagggtttcaccatgttgcccaggatggccctctgcattttaaaaattttattttttgaaacgaagtctcactctgtcacccaggctggagtgcggtggcacgatctcagctcactgcaaccttacctcccaggttcaagggattctcctgtgtcagcctcccaagtagctgggattacagacgtgcaccaccacgcccggctaatttttgtatttttagtagagacgggggtttcaccatattggccatgctggcctcgaactcctgacctcaggtgatccacccgtctcagcctcccaaagtgctgggattacaggcatgagccaccgcacccagcctgtcctctgcgttatctaaattttctttgacatgtacatccatcaaacacatgttctcacccaggagtctgacagcaggcctcattttagagaggtggacagtaactcaaaactcagtgccagttttctacctctgggaacaggctgacgccccgcccacctgactcccgcgcctcctaacttatcccaggcgtttcgggagttctcgccaatggcccaccctccatgcctcccagaccaggaagaagatgacacacttttatgccaccaaaggcggtcaactgacaggaaagaaacttcctcctcctgggagactgaggctaaggaatgatgcctctcctttttccctcctagaacttgactccctggtccgaatcgggaaaaccccattcagatgtagaaggattccaccagtgctaacaagacggtcaccagtgacaagtggatttaggagtgctcatctcatctgcaaacctgagtgttagtgacagaaccacggtgactttggacagagcacttcccgttccaaaagtgaacatgagtaaaaaatgagaacatcaatcacgcctgtaatcctagcactctaggaggccgagacgggtggatcacgaggtcacgatcgagaccatcctggccaacatggtgaaaccccgtctctactaaaaatacaaaaattagccaggcgtggtggtgcacacctgtagccccagctactcaagaggctgaggcaggagaatcacttgtacccgggaggcagaggttgcagtgagcagagatcgcaccactgcacgacagagcgagactgtctcaaaaaaaaaaaaaaaaaaaaaaaaaggaaacatcaaaacagccaagtgagaggcaaccacagagctgctgccactagaacaggacagggcacacctgcttaaggggacaaaaggaaacatcaaaacagccaagtgagaggcaaccacggagttgctgccactagaacaggacagggcacacctgcttaaggggagaaccctgctaacactggaatgagctgctttcgggctacccaccatgagcatctgacatgccacagaaccggttttatagacgagttttcttttgccaccgtcactgatctggctacacaggggctcggcctccactacggcagcttcagaggcggcagacgagcagctgagggcccgtgctacagacggagcagggcgggcttggattcgaggtctgctaccgacaggctcgatgctgttactcagctgctctaagcctcagccctttgtctgggaaaagcccgcctcacagagaggatgcgaggagaaatcacgcaagcacgtgacgcggcagctggcacgctacacacgacagctagcaggtgtcaccccgagagctacagccatgctgctgctcctaggaacagggggcagcacaaacagcccatgtggccagaaaggcaccagtctccctctcctcgctggtcagtctccaaacagacctcagccagccgcccccaggatggcaccagacaagacaggttctccattcgaaggttcttccaggatgaaaactcctcacaagaccctcagggcacaagtggacagagaacccggtctgaggaacgggatccctccaagcctctggaacccggcctccccaccgctcagacagctgcccctgcccttccaagtcggcaggccagtccctctctaaagacagttcaagggcagtgccacagccacacctgtatattccttgggggaagccgtgtctccattcctgaagaacttgatggtgggatagccgcgcacgccgtactgctgggccaggtcagactcctccgtggcgtccaccttggccaacctgatctcggaaccttctgccttcagcttcccagcggctttggcatactcaggggccagagccttgcagtggccacaccaaggggcatctggaagcggaaatgagatgctagaaagcagccttgatccctaaagcagccttgatccctcagcagtgcttccctttttcctctggcatttcccttcataaaaaccttatctactcaccaagataacccctcctaacgcacaaggctgagctgatagcctggtgttcttgggcaatatcaggacagaggccgtgaacgacaaactaccaccaaccaacaccagcccccactctgctatgtcaccatcagcacagccagacaaacctttcaatggttgctgacttcttattccccacaggcaactaaggcaaggatctcccctagactttccctttaagactacagacaaaagtgaagaagtgaccgtggcggcctgtaccagcactagctgtgagtatgagatgcacatccgtgcacacagaccctgagttgcttagggtgagaataagacgatctgtcaatagagttagcagctgtgtcaggcacaaggttcccaccccagggacagagctcaaatccttatggacgtgaggaaggcttgggattctcctctgagacaccatcggaaggactgctgtggcaagctgaaggtggggtgggcaggagcggggcgccttccgggtcggcccccggggaggactcggcaaggctggacactggcttgctctgtttgctcacacaggtcgatcctgttcttctcgcactaacaggaagatcctgccgtgcgcagggcgggcatcgggacggccccccggctcccagcccggctctcacccccagggagcccctgacatggcccccaaggcgggcagcaagggagcccttcagttccgggcgcgccgggggtcccgaccccgggggctgccgggccgtgcctgcgtcccaagagcctggctcagcggccccgagccccgcccgcccgccaggcccggcgctcacagaactccaccagcaggtacttgtgggccgccagcgcctccgcgaagttgcttttccgcagcaccaggacgtggtcctcctcctcgggggcgtcggcgcgcaccagggcggccacggccaggcacagcagagcgcggcgcagcatgtcggacacggatcaggcggggcgcttcggttggcgccgccgggacagcgggggcgacgagagcgcgcgccggtcccggcctcgcctttataaatcctgggtccggggcgcgcctgcccccccgcccgcgcgcgctggccgcggcgcgcacgcgccgctggggcccgccttcgattggccggcggacttcgaggctcgtctttgccgctctcggattggacactcacaccaggcctggccccggattcggaaacgctcctgagtgctccctggccttcgttcgggattggccgaggacctcgcgctcgctgtctttcttagcctctcattggctcccgacaagaactttttctgccttggcttctaattggtggctttcgcctgcaccttccacgggtctggaatggctgcccctttcggtagcacggactctgcgcctcctgattggccaagggatgcgcgcactctgcgcgttccttcgtcgaacgtggcagtggggaggagttcccagtttaggggcggagctgcggctgcgcttccgaaacccctcgtgttgcattctgactggaccgcgtacccaactggcacgccccccggcccccggaccggaagttggggtgacgcaatttccggcgcgcgtgtcaagcgtgcggcggcggccgtggaaggtggggttggccgcctagggtcggcggtgggctcggtgtgggatagccggcccggtccgacgcgctccgcgaggtcacgcgagacactcaccgaggcatggcggcagggcctgggcatgggaatcgtgcgcacagtgcgaggaagcctcggaggggatacgagcacagggcgggtggttaggagaatggggctggagagacgggcgggaggggcgggacctgggccccggggacctgccggctcccaggccccaggaagacgctgctcatgcgtggagcggccgcaggaaaggtactccccgctaaggccttcagggagcggccctttgccctgtgcgatctcttccttcctttcccacgggttgccaaatcctgtgacgctgccccttctctggtgcttctcagatgctctggtcggctcaggagacctcgcagctgttacacagctgtggaaataccctgggcgctgcttcactccgaaggcagcagctgggtttgcctcccgactcgacccgccaccgaggctcctgagcacttgaaatatggccagtccacctgagacgggctgtgagtgcgcaatgcacatcaaacttctaagactgagtgtgcggggccgagtgcggtggctcacgcctgtaatcccagcactttggaaggccgaggcgggcggatcacgaggtcaggagttcgagaccagcctgatcaacatggtgaaaccccctcacctcccgtctctactaaaaatacaaaaattaacagggcctggtggcgcgcgcctgtaatcccagctactcgggaggctgaggcaagagaatcgcttgaacccaggaggcagaggttgcagtgagccgagatcgcgccattgcactccagcctgggcaacagagcgagactccatctcaaaaaaaaaaaaaaaaaagtgtgcgtgtaggggctggaggacagaaggtacagtatttcgttaataactttacattgactactacatgttgaaatattctgtatgcatatgttggattacataataatattgaggccaggtgctgtgtggctcactcctgtaatcccaccacttttggagaccgaggcaggaggatcccttcagcccaggagttcgagaccagcctgggcaacatagtgagactcccgtctctacaaaaaataaattaaaaaaattagccaggcacggtggtgtgcacctgtggtcccagctacttgggaggtggaggtgggagaatcatttgagcccaggaggctgaggctgcggtgagccatgatcccaccactgcactccagcctgggcgacagatcgacaccctatctcaaaaaatagtaaaaaaatgtcctttttttaaaatttttattttttatttttttgagacagaatctcactttgtcatccaagctggagtgcagtgggcgatctcggctcactccacctcccggattcaagcgattctcctgcctcagcctcccgagtagctgggattacaggcatgcaccaccatgcccagctaatttttgtatttttagtagagacagggttttaccatgttggccaggctggtctcgaactcctgacgtcaggtgatccacccgccttggcctcccaaagcgttgggattataggcgtgagccaccgcaccaggcctcctcttctatcttttaacgtggcttttagaaacttttaaaattacatagatggtctgcattttgttagtgttggacactggcagccctccgtctccctcactgcctggaatctgctgctctccttttccccaggtgcctgccctctccattcctcctcactttcctccgctgggaatcggcaccgccactgattttaaagttgaaacttggcaggcaaaagggaggtactcccatgttaaatgtatacacattgactgcaatagtatcctgacttttgaaatggtaaaacgtagagtaagttgcttttgtactttgagagtttctgtttgttgatcagttgttcctgagaacatgcttctccttccgacagggaactccctccactagaatatgagctccttgtggtcaagactgggtcccctgttcccttccccccagtgccagcggagcaaaggtcagtcagcggcataagttgtacctgctgggagaactgtctgcttcctccgggtgacttttctggccaagaaggaatatgagtatgtgcctccctgagcactggcctggagcccactcaggaaacaccatctcttcataaatggttttgattgcaggcattgttccttctgctctctggatgatggaaattgcttcaggtcactgcactatcttccaacgtttttgtggttgccatgagctgttgtacagaccacagtttggggcctgagacaagctgggcatggtgttgcatgcctataatctcagctactttggagggtgaggcaggagaatagcttgggcccaggaggtctaggctgcagtgagccatgatcataccactgcacttctgtctgcgtgacagagaccctgtatcttacataaaaccccagcccatatttgtaccacatctagatacgaggtcagagttcagatgcctaaatattgtagcttgtgttttgtccactgttgggggaagagtgaagagatttgacataccataatgttgattagcttgtgatggtttggcggcagcttaggccagagcataaagtaaaaaggaaaagtgttcacagacaatgaaaactgggaccaagtggtgaatactcaaggcacacagaccaggcaaggatcccagtggccgtggatgagtctcaggctggctctgggccagtggaacacacctcagtgtgggtgaaggcctagccagggtagcagagggcagggctacagaacagcagcccaggtggctgtggccgacctgacattctcctgtgaaaatcaggtgcccaaccagcactaacctagatagatggcagcattttttttctttaaagacaggatcttgctatgttgctcaggctggtcttgaactcctgacctcaaaggatcctcccctcttcagcttcccaaagcactggggttacagatgtgagccagcacgcccagccgaatcacagtatcttagacagatgccatggctgcccatagggtcctctcaaggtgcctctgcccttggactggcttcctacaccaacctgacaggtgcagcaaaggtggactttctggtaaggctggaggaggaagcctggtctgcgatggcctgagacgccctctatgggggttgttgagtggatggaaatgtgcagggcatgggtcctgcccccaagaatgcaggctggttccgctgggcacctgcagagggctgatgtccttttcctgaggcctgctcctgtgccttctaaccctagggtgagaagatgggctgtgttcacctcatgcccaggcccttcgaggagtgtgcccttgggggtcagagccctcctgtggctggtatttctttggatcatcacaggtgctccagacatcctttagggagtctcaggcttggtgaagggatccattaaatgttgcttagttggtttttgtttgttttttgttttttcgagacagagtctccctctgttgcccaggctggagtgtggtggcgtgatcttggctcactgcaacctccacctcccaggttcaagcgattctcctgcaacctctgcctcccaggttcaagcgattctcctgccttggcctcctgagtagctgggattataagcgtgtaccaccaaccctggatgatttttgtatttttagtagaggcagggtttcaccatgtttgtcaggctggtctcgaactcctgacctcgtgatcctcctgcctcggcctcccaaagtgctgggattacaggcgtgagccatcatgcccagccaactggtttgtgattaaatgttttgattgatgcagtttttgaaatgtactgtgtgtacaatattactcttttgagacagggtctcactctgtcacctaggctggagcacagtggtgcagtcatggcccactgcagcctctgccttgtagcctcaagtgatcctcctgcttcagcctcctgagtagctgggactacagttgtgcaccaccatgcccacctaatttttatttttttaaagatggggtctcctgtgttgcccaggctggttttgaactgctgagctcaagtgatctgcttctggccagctactactcttaaaagtagagttctcagagcaaaacagctccctttcaaccttcagtccggtcgaaggtgtggtgggggtaacaacagcaggctcatggatacctgggcagtgctccgaggtccctcctgtgttcccactgagcagcagcctgctgtgcccggagtggaggtgagaaatccagcagcagcgcggtggtgagtgtgggccctgcggagtgtggcaggcgctcattatggtgcagggcagtgttgggcacagagaaggttctcagaaaccacagtaacccatggttagttggtcacatcccagaccctgacctagcactggctggcactgtgacttgtcactctcctgaatggaagaagtgtccacctgggggtggctgaggaggtggatgctaggggactgctgggagccacggacctgtggaggttgggagaggagactgcaggcgcaggctgctggaggcgaggaggcctctctggagcgccaggccatacaaacaggtcccaggtggggccacgaggatcaggttagacttgggacccgagagacacgtcatgcccactgtgcaggtgccacctcatgttatcctgcaccaggggaggggccagcccaaagtcctggctgctggcagcatgcccgtacagcttggcacctgggtctgagttcacatgtctagcaaagctgggaaaatccaggagcaagaaggtgaagccctttggctcagcccaagctcagaaggcccttgcccgatgagccgaactgctgacaacaccctggcactgggcttggggactcccctggagcatgtaagaagtgaactgggagcgtgggagaaactgtctggcaggggctgctgcctcggagctcatcctccctggctgtgctggtgtctgtccagtgggattagcctccatcctgtggtttcaccaccccaccgcctctctcccccacagcacaggcagaagcagcaacgcaacacgagaccacctcgcttggggctagtagcagttctgggaaaggctcggtagggtctttgctccctgcggaatcaagggctgggggctgacccaggctttctctatagctgcttccagatctgggtctggaccagcttctgcaggaaggcaccattctgttggggtgtctgacacggtcagctctaggctcagcctctgcggcccccacaaaggcctagcaaggatggggcaaggtggcagtggtgcccgcacgcactgccctggcacaggtgtgtagttagtgacctgaagcatgagggcatctccctgcccaccccagctggagataagccccttgcggggcccaccctgctgataaaccccagagcagtatggcctgtgtcagaatgaccagtaggagggccccggggtagcagctgcccagcccagctgcgtgtgtgtgtgaagtattttcctcaacaccttataccacagaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccccagtagccccttcacaccacaccgcagtgaggatgccctgtctcctgccgatcccatcacaccaagccttttcgctgttgggctcctggcactgcccgatcctggagggcacttggctgcggctgtggctgtgaagggctggtgctctaggcgcctccgtggcccccgttgcctgggcacctacttcctgcctcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcacttcaagggggccctgcccttcccctcccaccaccccaccagggtccccatcttcccctttgtctcctaaagcccgtgaggcagtagaggagccaggccctcccctgccacaccctggagaagccaagcagcagacacccccagctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgggggtggtggcactgagagcctgggggaacaggcgccaggccagtggcccagggacggcacggacggaggcaataaatactgatggccaggcggggctcctggctgggcccaggtggggtgggtgaggctgtccatcgagggctcttgggggggcgtgggctctgggcactgcccgctgagacagaaaaggcagaggcaggacaatacccagcctcctggatggtactgaggtgacttgagttttggcaatttggctttccccaagccgccggagccatctccacagccctgtccagggaagggggcaggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaagccaggcctcgggtgtgacggggagatagaacctggggggcacagaaagggcagcagaggcctggctgcggcctctctcccccacagcacaggcagaagcagcaacgagacaggagaccgaggaggctgggcctgtgggtgggggagggctgaggaggggggtcggaggcactcggttgagccaggccagggaggcggaccagggtgggaggggcacggagggcctgtcagcactttggtatggggaggggaggggctgggggggacacatccgcctgtccgtcgtccgtccgtcagtctgccctgcccgcctctggctgggctcagtccttccagtccttcttgatggtgagattccactcccaggacaggtggtcggtcttgtcgtcgtctgtgaagcgggacttgatgctgtagctgccccgggccagcatacccttgggtgcctcctccacgggggtcaggaactcgtactcctcggcccggggcccatagctgcctaccatgtagtcagtcttgtcaactgcggcacaaggaagagggcggtcagcggccccgcttccccgcctggcagcacgcacccaagcggccccctctgccctgcccggggccccactcactcttgacgcctttcctgtacgtatgctggatgtacttcatgccggacactatctctcggttaacctgcaggacccgaagcgaggatcagggaaggtcggtccggaccccagccccagccccgcctccattccctggccacagcagcctgtagcttacccggaaagagatttttatccggtactccacaccctccttcagcacaaacgactgcttcttgaagctctccaggtcgcctgttggggggacctccccctcaatgactgcccagcagccctgcgcgaagccccagccctgcgcggccccctggctgcacttcccgagatccccaccaggggccgcccggacccccgcggccgcagggcactcacccgtcaggtccagctccagggggcccggggccgagctgcacaccagggtcaggccagtcaccacgacgttggggacgttggggtctggggagtgacagcaggtgagggccccacccccaccagtggaagtaggggctggggagcggcaagacagctggagtgaacgggcggccacccggctcccgcagcccagactcacctgcggaaacggccacgcggcccagcagggcctccttgtactttcgcaggctctcgtcgtccttgtccagctcctggatctcctggatgctcttctgggccgggggcttgtagttgaccgagtgctcatcctcctcgttctccgctgcaatctgggccagctgctcggctgtgggctcctgctcagccatgctcaagcttagcctgggtcgggacacctgtgggcgggacggtgacaggccttggacctggatccccaacggaggcgcacttctgagcaggagtgtgggctgcagccggagctccaaaagggctccaagggggccaccttcgctcctctccacccccgcgattcctgctcaggggcatcctctggggcagtgtgaggtgcccccaccccaggtataacatctaagacaaaatgggaactgcagccgatcatggggagagaggacacacctccccctccacgatggaggaggcagcagccccctgtatgtgtggggcggggctagcaggccccagaatcaaccggcggggcccacactaaaccctctcttagggtcttgccgctcttgagctgcccaggccctcgccctacggggtaacggggctcggtatccctcagtagggttgctcctctggccgtggtagtcacatgtaaacgtgtgtggtcggctcagcgtcatctttcaaacaggatgcccctggagctcggatgttaggggcagctagaataccgcacggggccacctggacacggggatcctaagtatctgcggtttctccacaattgtgagggtctgtgacctacaacttgggagctaccacagccactcagtactctcgggccctcttgtagatggtgggcccggagtgcccggggcagcactgacccggcaggggatctgtcaggctcagatccttcccggcagcgtgggaggtgggtcagggagcagcacacccgggacacccaggccggggtccaggccgccctgcttcctccaggggctggggcctccgcgccgcgcgaggatagccgtaggcgccgggatcctagggcgcggcccgcacttccgcagggcccgcaatccgtgccgggcgtggcccgggcgctgggggaggccgcgccccaatccccgcgtcgcccccgaacgcgatggaccgcggctgccggcccggcgccccccgcgtccccaaggaggggccctcaggtctggcccgggccccacgcgcctcggcggccatgaaagaagctccggaccgctcgggaggggccggcactcccctggtccccgccgcccctccggcccgggacccgcacgtggggccggggccgccgccgcccggtcccgccccggccccgccctagcccgcaccgccctggcccgctgtcaccgcgcccccgcccgccgagaccctgccgcgggctcagggcggggcgcgaacaaaggcggaagcccccacctcagcgccccccgcccccgccggcgccgccggtccccgccccgacccgccgcctccgccccgccgcctccgccccgccacggccactcaccggagggttcggccgcgcggttcaggatccctcccgcactaaatgacgaacgtcgtcggccgccccgcccgccctgcctgtcacttccggggtcacgagacttccgctcactcgggcggggaaggccagggcgcatgcgcggcgcgcgggtggccgggggcacgccgtcgccatcttgcggctgggcctcgtgggcgcgttccgcgtgggttctggcgtcgtcaccttccaccccaagccccgtcagtggtcacctctgtaagccagggcacttccctacgcgagcccagggcgcccgcacccgggaggcgaggtccggtcccgcctctcgccgctgcccaacccgcgcccactcgaggcctgcggcggccgcgtgggctgtggaagcccgcgcaggtgcagtgcgctgccctccccggcccagtcggtccgactgcgactcttgcttcggggcctagtcacctagtcccgggacttcggggaggtaacgggcacggggattaagttctcgttaaacacgggcgagagcgctggcgcgcgggccgttccagggccttggtgtcccccgtggaaagacagggctgtggggctaggaggagccccttgcacgccccgcggaaagctggtgctgggcgagggcgcagcggaggtgtttttctccaggctgagacagaattcgtgcgcagcgcgcgtggctgcctggcgcaggcgccgctgcagaggccctagtgtccctgaggaatcccgcggctcctcaggaccaggaggcagggagctcctggcaccgtgagcagatgaggggctgcctcagcctgggcttcaccgcagagccctgttccccactccgcttgttccgagattccacacattcgcccacaagggccgtgttgaagtatcaggaacggccgcataacgtgagtggcctggcccagcagcagtgctcgcacccagccccgggctcgcctctcctggaggccaagcccctaaatgccctgcaccagacactgggtgggacgctgccccgcgtccagcctgcagcacttgttaggactgtggactcgttaacgtggacgcctcttttatttattgattgattatttttttgagacgtagtctcagtgtcgcccaggcttgagtacaatggcacaatctcggctcactgcaacctccacctttcaggttcaagcgattctcctgcctcagcctcccgagtagttaggattacaagtgtgagccaacatgcccagctaatttttgtatttttagtagcgacagggtttcaccatgttggccaagctggtctcgaattcctgacctcaggtgatccacccacctcagcctcccaaagcgctgggattacaggcatgaaccaccggggtgcccaatcttttttttttttttttttttttcttcaagacagggtcttgctcttttgcccaggctggagtgcagtggtacaatctcagcttactgctgcctctatctcctgggctcaagcagtccttccacctcagcctcccgagtagctgggactacaggtgtgcaacaccatgtccagctaattttttattttttgtacagacagggtctcactatgttgctcaggctggtcttgaacccctgagctcaagcgatcctcctgcctcagcctcccaaagtgctaggattacaggtgtgagccaccatgtccggccacccagcctcttttaatcactcttgagctccatgcagacagggccctgtctgtttggcccatactgccaggcaacccaggctgatcaagagaagtggagaccacacgcacacacacacgcacagctgctttgttcagacacagacatgaacacaggagggcatttttggggacagaactatgcaaaataccgagcttggtgtcttttgaaaatttctgaatgttggagggatatttgagagtttctgtaactgagtcacactgtcagtgccatgtcatcagcacagcgtttcctaatcaggtgtgaaatgcttcactgttaaagactcagagcccctgtgcaggtgatcatgttgcccaactttccaataacccaagtgcttttaaaaaaaaactgttgggccgggcgcggtggctcacgcctgtaatcccagcactttgggaggccgaggcgggcggatcacgaagtcaggagatcgagattgtcctggctaacacggtgaaaccccgtctctactaaaaatacaaaaaattagccaggcgtggttgcaggtgcgtgtagtcccagctactcgggagggtgaggcaggagaatggcgtgaacccgggaggcggaacttgcagtgagtggagatctcgccactgcactccagccggggcgacagagcgagactctgtcaaaataaataaataaatacataaataaaagattcgattgtgtgggtatacattttgtttgtaaccattccagttggcaaatatttggtttcttttttgtccattatgaataatactgccataaacatttacgaatattataaaccattataaatgttgcattaagccttttcatgaatatgtgctttcatttctcttgggtagattcctgagtggaagtccccaaatgttttccaatgtaggtgtgccactttgcaccccctagcaacgctgggctgctccaggtggccacaggctcagcaatacctgctgtgcttcatcccagctgtacaagtgtgaagcagtgtcgtgtcacactgtgagtcgcacctgcacttccccaatgagtcttcctgggcagaaacctatttaaatcttttgctcatttttaattgggctgtctgattaagctatgagtacttacatatcctgtatacagtcctttatcagatatatgaggctgggtgcagtggctcacgcctgtaatcccagcactttgggaggccgaggcaggcggatcacctgaggccaagagtttgagaccagcctggccagcatagcaaaaaaactgtctctaccaaaaatacaaaaattagccgggtgtggtggtgcacgcctgtagtcccagctattcgggaggctgaagcaacacaatcgcttgatcccagaaagcagaggctgcagtgagctgagattgccccattgcactccagcctgggcaacaagagcaaaactctgtctccaaaagaaaaagataggtgatttgcagacattttatgtggtttgtctttcattttcttaatgatgtcttcttaagggcaaaaccttttattctagtgcagtagttttttccacatggtgcatgcctttgctatcctaagaactcctgagctgaggtaggcggatcacttgagcccgtgatgtcgaggctgcagtcagctatgattgtaccactgcactccagcctgggtgacagagaccctgtctcaaaaacaaactcttagcccaaccggatattgtaaagattctctctcatattttttctgtgatcttctgctatattttatgtttgctgacatttagatatacagtccgtatttgggttaacttttcgtatggagtgaacatcttttctgtgtgtaggaacatccacctgtcctggcaccccttgttgagaaactatcgtttcccccaatgcaatgtctcaccacctttgttgaaaatttattcaccataggccgggtgcagtggctcacgcctgtaatcccagcactttgggaggccaaggcaggcgcaacacctgaggtcaggagtttgagaccagcctgcccaatgtggtggaaccccgtctctactaaaaatacaaaaattagccgggcgtggtggcacatgcctgtagtcccagctactcgtgaggctgaggtgggagaatggtgtgaacccgtgaggcagaggtttgcagtgagccaagatcgtgccattgcactccagcctgggcaacaagagcaaaattccatctcaaaaaaaaaatttttgttcatgtaaatcgaagggtttattacaaaaattagctgggcatggtggcgcacacctgtagtcccagctactctggaggctgaggtgggaggatcacctgagcctgggaggtcaaggctgcagtgagctgtgatcatgccactgcactccagccttggtgacaaaaggagatcctgttgctgggcatggtggctcatgcctgtaatcccagcactttgggaggccgaggtgggtggatcacctgaggtcaggagttcaagaccaacctggccaacatggtgaaacgtggtctccactaaaaaatataaaactagccaggcatggtggcacatgcgtgtaatcctagctacttaggaggctgaggcaggagaattgcttgaaaccgggaggcagaagttgcagtgagccgtgatagcgccattgcactccaacctaggtgacaagagcaaaactctgtctccaaaaaaaaaaaaccaaaaaaaggccaagtgcggtggctcacgcctgtaatcccagcactttgggaggctgaggcagatggatcacctgaggtcaggagttcaagaccagcctggccaacatggtaaaaaccccatctctactaaaaatacaaaattagccgggcctggtggtaggtgcctgtaatcccaggtactcgggaggctaaggcagaattattgcttggacctgggaggcagatgctgcagtgagttgagatggcaccattgcgctctagcctgggcagcagagagaccctgtctctcaaaaaaaaaaaaaaaaaaaaaaaaaggacaaaaaaagacagacagacatatatgtctttgccaatgctacgtcctaaaatgatggcatcacattaactggctttcttgcattactaaaaggatgaacttttaaaataattttgttatttaaaaaccttgtttatttttatttgttgagatggagtcctgctctgttcccgaggctggagtgcagtggtgcgatcttggctcaccacaacctccacctcccaggttgaagcaattttcctgcctcagcctcccgagtagctgggactacaggcacgcaccaccatgcccagctagtttttgtatttttagtagaggcggggtttcaccatgttggccaggctggtcttgaactcccgacgtcgtaatcctcctgcctcagcctaccaaagtgctgggattacagatgtgagccaccgtacccggccagaaacaactgttttttaatttttcttttgagacggagtctggctctgttgcccagactggagtgcaatagtgcgatctcggctcaccgcaacctccgcctcccaggttcaagcgattctctcctgcctgagcctcctgaggagcttgggactacaggcacacgccaccacgcccagctaatttttgtattcttagtagagacggggtttcaccatttaggccaggatggttttgatctcttgaccttgtgatcgcctcagcctcccaaagtgctgggattacaggcgtgagcccctacacccggccgaaacaactttttaagatagaatctatgttgttcaggctggattcaagttcctgggctcaagtgatcctcctacctcagcctcccaagcagctgggactataggcatgtaccacttcgtccagcttccggctttttccatggttgtaaactgcctattcatgttcttggtggtaaatgtttcccaaggttgtttgtcttgaatttgtgagattgtctgatttgcagaagtttttgtttgagagtcttgctctgtcacccaggcagtacagtggcacgatcttggctcagtgcatcctccacctctggagctcaagggatcctcccacctcatcctcccgagtagttgggaccacaggtggcaccatcatgcccagttaatttttttctttttatgttacagcaatgagtctgggtactttttgcattttttaaatgttttttgtagagatgggttttgccatgttgcccaggttggtgacttacagaagtttttttttttttttttttttttttttttttttttttgagacggagtctcgctgtcgcccaggctggagggcagtggccggatctcagctcactgcaagctctgcctcctcggtttacaccattctcctgcctcagcctcccgagtagctgggactacaggtacccaccaccacacctagctaattttttgtatttttagtagagacggggtttcaccgtgttagccaggatgatctcgatctcctgaccttatgatctgcccgcctcggcctcccaaagtgccgggattactggcatgagccaccgcgcccggcctacagttttaaaaagtccttactgtcctgcaaagatagggactcttttttacctaacaataccatgaacacacccaccaaaactgacaatgctttctgacatctaatagtctctgctcaattttccccaagtctcttcttgcaattgtgtccccacatcagaatctggacagaggccgtgctgtgcactgggatgcccactgcctctatttcctcttctgcgcttggtgccacccaggcgtccaggagccagtgtgttttgctgacaatgtcctgtgttctggatttgctgggctgaaccctccaggtgtcctgtgaaccctctcccatcctctgcacttcttaggcaggatgagcccagttcgagttttagaggcggtgctgggggcctcctgctgcttcacgtcattggacttgtcttctggtcctacctgtagtgaggtatggttggttctgggaagctgggctggtccacccattatcagtggcctcctcaactgtcatcttcaattttcactgtttctcacatgcatcattttattggacacttcaaagtggtgattttctaattttgggtgtgttttttttttttttttttgagagagtcttgctcttttgcccaggctggagtgcagtggcgcactctcggctcactgcaacctccacctcctgagttcaagtgattctcatgcctcggcctcccaaagtgctggagttacaggcatgagccaccgtgcctggcctgattttctaattatttctgtatttcttagctggaattatttcttttttttttaaaggaccccgtcatcaattgttgccccaaaattatagagttcatacagaaaagacaaattaaatgcccgattctttccttttatttgccaatttttatgagtcagtgccttacaacttccaaaggtaaacatgaggcttctttccttaagcatcatcatgaactcttagatgttcatttattcaacacaaactaaaaaaggaatgttaagtcttaagatatcattaatactaacttgcattacttgtttatgaaggattaatatactaaatagaatatatgctcacatttttatatgtagatattaatttacaagtaattaacatgctaaaacattttataattcgcttcaataacgtgtatagataacacaaaaattaactctggcctaccttaggctacatgatcacagacaagctgatgtaattaaaatgagaagatttatttcttggtactttcatggctttatttttacattaaagtcttttatgatgtattatttattgctatcttccaccaaatgcttggccagtcaatcccagggtgatcttaataataacaactaatacatgtaaaccataaacatttatgaaaattatatatcctcatataaatttcataacatatgtaagttacaaaagaaagaaaaagtcaacgaggatatgggggaagccaaaaggaatacaaactaacaaatgaacctaactatgtacaaattatgcaaatcacataatttgcaggaggtggaaagaaagaaaagaactcatctaggcaacttttgaaaccagtacttagatgctacaggtcaaacacaaaaacaacagtacacgattaaggaagtaaggtgcctccatagtgactgcgcctccctggggcacaggttgaacagttcacctacagcactgacatggcctaagcgaatgtcctgtcaatctgagagccaggtttctccctgtcacaggaagaaactacacataaggaaaggggcaggtgagacaggaacagcaggaactagacagctacagaaaccaacagggcgggtaaatgcacaagcacgtgtcatagatccacttcccagctctgtcccaggagggcccagaagcaacaagcacagccagtgcccaggtcttggttgctaaatcccagtctccagtgagggagggctccctggagaagcagctgggtgcagagctgggacaaggaaaactgaagacatcccaaaataaacaagtgcttaaataaggatagggcacaggagacaatctccaggagctcccaatggccaaagcgtggaaacagtatcagattatgactcacagaatccaacaaacagcccttgcgttcatactgatatataaagaaagaaatcgtaggtcaggcgcagtggctcatgccttttgggaggccaaggcgggcggatcacttgagctcgaaaatttgagaccagcctgagcaacatgggtaaaccccatctctacaaaaaatacaaaaagtcagctgggcatggtggtgagcacctgtggttctggttactcaggaggctgagatgggagatcacgtgagcccgggaggtcgaggctgcagtgagccgtgatcgagccactgcactgcagcctgagccgcagagcaagaccctgtctcaaaaaaaaaaaagggaaaaaagctgaagggactgctctttcttagagatgaattccaattaataaacgtcaaaggaatgaggaaaatgcaaaaatcacctttgaaaactaagttaataattactgcattgcaagacccaccagtggatgctgaaattaattagtgggtaggccgggcacggtggctcacgcctgtaatcctagcaccttgggaggctgaggcaggtggactgcctgagctcaggagttggagaccagcctgggcaacacggtgaaaccccgtctctactaaaaataaaaaaaattacctgggcatggtggcgcgtgcctgtaatcccagctacttgggaggctgagacaggggaattgcttgaacctgggaggcggaggttgcagtgagctgagatggcgccattgcactacagcctcggcaaaagtgagactccatctcaaaaaaaaaaaaaaaagtgggtaaaacttggaagtgaaacagacattcacttagtctggaagtatctccccaaggtatttatggatgacaaagggaaaacagtaactatgtaggggagaagccccggcagccgctgccaccacctgaactaacaggaccaggagttggacagactgacattgcatatctccactatgcattgagaagatgacatcccagctgtggtattcatgccaaaaaataaaataaaccagcagggcgtggtggctcaggcctgtaatcccagcacttttgggaggccaaggcggatggatcatgaggtcaggagttcaagaccagcctggccagcatggtgaaaccttgtctctaataaaaatacaataattagccgggtgtggtggcgggtgcctaaaatcccagctactcaggaggctgaggaaggagaatcgcttgaacctgggaggcagagattgcagtgagctgagatcacaccaccgcactccagcttagaagacagagaaagactccgtctcaaaaaaaaaaaaaaaaacaaaaaacaaaaccttgtccagtcataaggtcagagtccccagtgtgagggacattctacaaaatagctgagagtaccctttaaaagtgtcaaggtcataaaagacaaaagcttctataaatctgaatataaaaataacacttcagaaaattcataaatagagaaataggctgacattaataggctatgttcggtgtggtggctcaggcctgtaattccaacactttgggagaccaaggcaggaggatccctggagcacaagagttcaagaccaacctgggcaacatagtgagaccccatctatacaaagttttaaaaatcagccaggcgcggtggtgggtgtctgtagtcccagctactaaggaggctgaggtgggagatcccttgatcccgggagttccaggatgcagtgagctgtgtttgcgccactgcactctagcctggacatcagagggagaccttgtctcaaaacacaatttttcaaaaatttagttttttaaaaaagatattgagatgctacaatgtccatttcaggaagaatatcatagcacttttgagacaagtttctttttttttttgagacacagtctcgctctgtcacccaggctggagtgcagtggtgcaatcttggctcactgcaagctccgcctcctgggttcacgccattctcctgcctcagcctccccagtagctgggactacaggggcccgccaccacgcctggctaattttttgtatttatagtagagacggggtttcaccatgttagccaggatggtctcgatctcctgactttgtgatctgcctgcctcagcctctcaatgtgccgggattacaggcgtgagccactgcgcccagcctgagacaagtttttctacaaaatgtaatgacattaaggtaatatgaagagacatgatcctcatctttatgtaactggagttcaggtattcattacgctcaacaatatcaaccttttatgatgctattttgttgaatgtgatgaatgccactgataataggacatttaattccatttagaatatctgtatttccaagtaaagtcctaaatctgccagggtggagatttatccatggtaaagtctattcaatccagatataaaaaagatagagattgagggccaggcgcggtggctcacacctgtaatcccagcactttgggaggccgaggtgggcggatcacaaggtcaggagatcaagaccagcctggccaacatggtgagaccctgtctctactaaaaatacaaaaattagctgggcatggcggcacgtgcctgtaatcccagccacttgggaggctgaagcagaagaattgcttgaacggggacccgggaggcagaggctgttgtgagctgagattgcaccactgcactccagcctgggctacagagcgagactctgtctcaaaaaaaaaaaaaaaaaaaaaaaaaaaagagagattaaagacatttaaaaaaaagattacaaagaagaaactgcaaagcaaaatcacaatgagatattacttcacacccagtaggatgactaaactaaaaaaggtaagtgttggtgagaatgtggagaaattggaaccctcatacattgctggtagaaatataaaatgctgcagctgctttggaaaagtctggcagttcctcaaaaaattaaacagttacctcatgacccggcaattctactcgagaattgaaaagatgttaatataaaatgtatacaaaaatgttcacagcagcattattcttataaagccacggagtggagacaacccaaatgtccatgaacagatggacaaaaaaaaaatatgcggtatatccatgtcagtagtcggccataaaaaggaacagtcttagacatggtacagcacagatgcaccttaaaaatgctggctggggacaggcgcagtggctcacacctgtaatcccagcactttgggaggctgaggcgggcagatcacgaggtcaggagatagagaccatcctggctaacaaggtggaaccccatctctactaaaaatacaaaaaactagctgggcatggtggctgctgcctgtagtcccagctactcaggaggctgaggcaggagattggcaagaacccaggaggcggagcttgcagtgagccgagatcgcgccactgcactccatcctgggcaacagagcaagactctgcttcaaaaaaaaaaaaaaaaagaaaaagaaaaaaaaaataaccgggcaaggtggcaggtacctgtaatcccagctacttgggagactgaggcaggagaattgcttgaacccaggaggcggaggttgcagtgagccgagattgcgccatggcactccagcccaagtgacaagagtgaaactccatctcaaaaaaaaaaaaaaaagaaaataaaaaaacttgctgggcgtggtggcatgtgcctgtggtcccagctacttgggaggctgaggtgggaagattgcttgagcccaggagtttgcatttacagtaagctatgattgagctaccacactccagcctagagagcaagaccctgtctcttgaaaaaagaaacccggtcgggcgcggtggctcacgcctgtattcccagcactttgggaggccgaggggggcggatcacgaggtcaggagatcgagaccatcctggtgaccacggtgaaaccccgtctctactaaaaatacaaaaaattaagccgggcgtggtggcgggcgcctgtagtcccagctactcgggaggctgaggcaggagaatggcgtgaacctgggaggcggagcttgcagtgagtggagattgcgccactgcactccagcctgtgtgacagaggaagactccgtctcaaaaaaacaaaaacaaaaaaaaccataggctgggcgcagtggctcatgcctgtaatcccagcactttgggaggcccagctgggcggatcatgaggtcaggagatcgagaccatcctggctaacccggtgaaaccccatctctactaaaaatacgaaaaactagctgggcatggtggcgggtgcctgtagtcccagctactcaggaggctgaggcaggagaatcgattcaacccgggaggcggaggttgcagtgaggtgaaatcatgccaccacacacgtctgggaaacaggaacgaaactccatctcaaaagaaaaaaacaaaaaacgaaaaaacaacctctaaaatgaaagactgtatccctagattgctgagaggtaaatgaaatgtatgtagaacatccagcagaggtgcagcctcagacactggctgaccatttgtgcaacctgagagaggcgtgctcttgcagcttgagttccaaccatgccccacactccactcccattaggctacactgcaacctatcacttgtatgtttcctatattagaccatcagttcactgcatgttaagaaccaaaagttaccatttacatgacaactctgttgccaggtacagacatagccatctcatgagatctaaaaggatgtctgagagcaacactgtagccctttaacccacgtgaggctgaacaggattcaatcagctgcccagtgtagactgctccttagatctccgtgcacaccagccagaaaccagagcactgtgggagcgtgtgcacgctcacatccgagaccctctccagggacctcaggctgaagacggagctgggcagaccatgagccaccctggaagagctccaagtcccacaggaatgctgcctctcctgcccggggctggccagttcctactctcagcccatgccggccagggaaagggaccaggaagaacagggcttcccttttctccccaccctgagtgtaatttcgcttgtcgacacttaagtcatgtgtccaacctgggccaatccctgtgctttctttttttgccccgagatggagttgtgctctttttcacccaggctggagtgcgatggcgcgatctcggctcactgcaacctccacctcctgggttcaagcgattctcctgcctcagcctccggagtagctgggattacaggtgcatggcaccatggaaccacaggacagccagaggcagagggggttccccaagtgcccatggggcacaggctgccagttcagtttgtcagccatagctcgctgtctgagcaaagcatcactcagtcaccatgtggggggcagcagggcactgggcagtgtggagtgtccgccctgcaaggccctgtgcccggaggactggcagcacccttcaagaggggaccagacagcccagctggccaaggcctcatgtctacttgctgtctgtgcagtcagtggaagagccctgctcttctttctctcacaagcaccctgctggaacaataaattaaatagtcctctggccttggaagtaaaataaggttttgtgttttatgaataaggaaatgaagattgggtatgatgaggctcagcccagctacctgacctgctgcccaccagaagccccggtggcttccagacccagcctctatcctagttataaatggccagccccacctccaccacaggcacagaatcaggtcattctcctttgaccactcggcagcacctgcctcaatgaccccaccactggccccccagcaaataccagctgttgcttctatgacatcattctctctacttcctttacctccaaccctcccaagaccatgccacatatggacacgacttcgacgtgtccacgtgctatcagctgacaaactggagaggtccggctctaggcaacgctctcctgcgggccagctggtgcctctgcccagcctgtccaatgctgacgcccctcagctggctccttcctggggccttctctccagtgacacctacccacccagttccccaaggcctcatattacttcattcccatgcccctcactcccgagaatgccaggaagtcccaaatcctggtcattcctccctccaaatgcctgttacaccactactgcacaaccaaagcaatgctgcttgtcagtcctgtcatttgtcacaccctgcaggggctgaccacaccagtccatcaggtgccctctccacttcctaagcagcagggagccagtcctagcacggccccagagagcagaccccctgcctggcatgggcctgctcaggccttgctccaacaccgaggcccgggccaagggcacctgcttggggataacctgactctaactcactgcactggtgacattttctgtcacattcacagcgactacagctggggacttagtaatcctttctcctgctagactgggcttctggaagggccaagattagtcatcctgttcatctgggttcctagactgtggccctggctggcattgggcaagctgcttagatggcagctgctgatctgtagtgacatctgtgaccgacagcgaaagaaccacccttagtcacactcccttgcccatgactcagccaggcccatcccagcgtggaagcaagcttagcctgggatgtgtgcccgcaggagccgctggtgcagggaaaggtttctgcagacacggcatgcattcctgtctgtctctccactaccactgcccactgccctgggcttccttacatcccagctgtgggacagtggggtcaggcagaactctggagctcccttgtcccccttcccatctcattctcaaagtgctgtcaccaacccagcatcagggggcacaaggctctctctccactgcccagcttggagtgcagtggcatgataatggctcacagcagcctcaacctccagggctcaagcgatcctcccacctcagcctttagaatagctgagaccacaggagcacgccaccacactcagctaacttttgtatttttagtagagatagggttttgccatgttgcctaggctggtctcgaacttctgggctcaagagatccttctgccctgacctcccaaagtgctgggattacaggtatcaggcgttgccctactcctttttgagacggagttcactcttgttgtccagactggagtgcaatggcacaatctcggctcactgcaacctccacctccctggttcaggcgattctccagcctcagcctcccaagtagctgggattacaggcatgcaccaccacacccagctaattttgtatttttagtagagacggggtttcgccatgttggccaggctggtcttgaactcctgacctcaggtgatctgcctgccccagcctcccaaagtgctgggattacaggcgtgagccaccgcgcccagccgccccactcttaaatggacggattatcacagcttccaccagccacttcatcaaatatacaactaagagaggatcctcatgccttgctccgtggcaaggttaaaaacaacaacaaaaaaacaaacagaaaaaggaattacactacaaagtcaaaactgctgaatccacgtttctctgaaaaccagagtacaagaaggaaaggaacagcccagagatgttctggctgtgggaagcctgtggacggcacacagggcagccatcccaccccaacctcccctcacctggaggcacaggcacaagggtcaacaggtggctcccgggcaaaggtgtcctcccacctggtgagttagagaggaaggtgttaggtgtgaggcaggaaagaagataagaaagaagacaggcagcttcggccctccaggagcggggaccccccgccacccccacaacccatgccaacttcaggtgtccaacaccagatggggctgctccctccatccccaactcaggttctcccaccccctcccagctggacagacaccaaaatcctggcccaggcctggactccaacagtgggacgaatcaaacagttccagttctacacacatttctattttattatggaaaaggtggaaacgccaccttctccacaacagcaaccagtaaaatttatcccaaaaataactcggtacaaaacaggtctgtttcagaattaaaaaaaaaaaaaaagaaaaaaaaaaaacctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccatctgaaacacagaggagaaagaggcttgcattcacaggcggcctgctccccactgcggctttgaccaggcccccagctggctcccccgggactcactctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctagcaaggaagacgaaaccgttcacacacccggaaggaccctaagagcgacgcagcctcaccctcggccaatccccttccccagaggccccggaagtcacctctgtgcaggcctccgctgtgcgtcaatctgtgacgtgacaagctgaatgttcatggggcggcctgcggcaaagaatacgagaaggcacgttctattgagaggctctgaaacccacccagctggcgccacaccctggtctccatgcaaacactggaaagggcctctgtgcgtctcaaatgcccccgacaagggaaatggcctggagatactggtgggagaacaaaatggcaaggaagcaaccccaccaacacctcctcactccttctcagtccagactaggtgggctgctcgctgaggtatcggggtgctcgtgggtggagaggtgtgggtgacctgacgaagaagaaccggtacctttgtctttacgactacagccccgcactcagaggtgtactatggcggttctgagaaggcttcacagaagtgaatcttccggaaggagctgaaggaggggagggatgtagcttgctggatgggggttcacaagaggttggtccagatgtgtggggcagcatgagaggtggcagatggaagagagagacaaaggggcaaatgcaaagtgtcctcagccacaggggtaccccatattcctacctggacaggtgccagccccaaactccacaagccccacagtcagcgtgggtccacccccagactcaccatccagagggacgccgttgtactgcttcatggccttcagggcatctgccttccgctcaaagtgcacgtctgctgttcctaagctgcgaccagagcgatcatagtgcacagccgccttcttcagcgttccaaattcagcaaagagttcctgggagttgcagagagcagttgtcagaaaagcaacaaaactgcgttccttctggtggcccagggacaggccctggaagcgtgagttgctttgggggtggttctctgggaggcaggacagtggttaacgggaaatgagggaagggcggggcaggagggacagcaacttccaagagcacctgggtctgagggctcctgccattgtggggacctgacacgtgtaccacgatgcaggtagaggaagctgcaaagcccactagcaacgggcacaaaattaagccactatcctcttcaacaaaggaaaatgtacaacacacccaagggctgttccaagaaacggtaaaggccaaaatcaagagcaagggaagcagtccgatatcagaccagcttgaagggcctgtagattcgggagccctgaccccagcccctcccccaaaggcagattctggctcacctttccctctcctcctactcaagcctgcggcaaagtctgaagtcaagcgctgtcatggaaactgccctgacctcaggcaggctgggagttggagagggaacccagagtgtggggatactccggccgcaggcacacagcgggaactggagttcaccaaaagcggtttccagtggatgctagaaaccaccttaaaaaaagtgttgagacactgtgagtgctcactggccctactctgtcctcccaaggcaaatggctgggctgtgggcaactgaaccctgcccagccatctccaaaactgattcccaaaaagtcatttcttaaccagaaaacaagttgaaatgccattgggattcaatttttctttttttaaaaaagaaaagcttcaaccaaagatggatttgagagtcatgtcactgacgggacacggcggtggggagtgataaaaccacagcgtacaaggtctttataagacagtactcaaggcaaacagagccagaaaaacagactccctgtgcttcacaagatacataaagaagattctttttctcacattaacccactaagacaggcacaaaatttaaaaagcaactgggctgggtctaacagccaaaaaccactcacatttggtcagtctttgtccctgttagaaactggaagccctggcaggggattttcactcacagaacccatcttcagactaacagcagcagttcctcaggctcagctaggctcgcacctgcctgcgcactgaccccggctttactagcactgggtctgtcctgcagcccttcagagctgggagggctcccttcgctaaggcgggaaggggactcagggccacatccccaaaatcacgatccgtcctgtgcagggcgaacggctcaccgagaagccctcgtctcttacctgaatatcggcgtctgagactccaaaatccagattggacaccagcagtttcccacctgtctccacgccggcaccaccgccgaagccactgtcgaaaagatcgtgctgccacttgtcgggaagttgttttggctgaaaaaaaaaccgcaacaagagcagatctgtgagtctcagtccagggctttcctgaccctcacggctactccggacccttcctcttcccggcctgagaggatccggccgaaacggggccgccagcgctccctccggcgctgcagctgccccagcccgaggccgcacggtcccaccgcggccgcacaacttcagttcccttagactaacttcccgccgcctgtgccgcgcccagcgtcccctcctctcctgccacgaggccccaacgtccggaacaaacaaagagctgggaagggtctcagcctccgggaccggaccccgaaagaacgacctcgctcccgcccaccaccccctccgcgcccacacgcaccctccggacctccgggcggccgctccaccagccttatccacccgccggcccgggtctccgccgcgagcggccccggccccagccccggctggccccctcccactctccggcgcggccggcctccgcactcaccctgctgtagggcgccggtcggttcctgccgcctccgccggccgcgccgcgggcgatggccggccggttccggatgggcccgccgcctcgattcactcgcgcggcggcctgcgccccaccgccgcggccgccctgggagccggcccggccgcggccccggcccccgccccggccgcctcgctggctccggttcagtttaatgatgtcgtccagagacatgtccattttgtcggccatggcgggcgcggaatcgggcatcggctcgagcccgcgcgtcagcacgccggcacgtcacttccggcgccgcgtgaggccttccggtgccacggcctcggagcggctgctgattggccgctggcggacggctgcgcgcgcgggacggggtgaggcggggaggcgcgtgcgcactggcgtgcgagactcggcgggcgctgttgagggagtcgggccgcgactgtggtcgtttttataccttcccgcgcggacgccggcgctgccaacggaagggcgggtagggcggtgcgtgattaggttggcgaaggtgcgagggcgcagggggtggggcggcggccgttggaggcggagcctacgcgcccctccctccccgcacgctccgcccgatcggccagggctgggggcgctgggggcgctacgggcgcggcgggtgcctgggagctgctgggagtccttgtttccgctcccgcccaggactgtgcgctcggctcgcggtggggtccggcgggcgcggcttcggcgggcggcagccgctgcagacgagctgcgggttggttttttggtctccacctgcagcccccccaagtctgcactgtcacattttgccagtcatatcctttacaagttttcttgcgggccgggcgcgggcctcacgcctgtaatcccagcactttgggaggccgaggcaagaggttcgcttcagcccaggagtttgagaccagccggggcaacatcgtgagacccccatctctaaaaaaaaaaatgagctgggcatggtggtgcacttctgtactaccagctacttgggaggccgaggtgggaggattgcttgagcccaggaggtcgaggctgcagtgagccgtggtggcaccactgcactccagcctgggcgacagagccagaccctgtctccaaaaaaaaattatttttgcaacttattaatgaaaaccagtgtgccatttcattgattttttttttttttttttgaggcagtctcattctgtcgcccaggctggagtgcagtggggcgatctcggctcactgcaacctctgcctcctgggttcaagcgagtctccagcggcagcctcccgagtagctgggactacaggcacgtgccaccatacctggctaatgtttgtatttttaatagagacagggtttcgccatgttggccagggtggtcttgaactcctgacctcagatgatccgcccgccttggcctcccaaagtgctgggattacaggcatgagccaccacacccagcccatttcatggattttaagttgttttgagatacttgcttttgtttttgttttttgagtcagggtctccctccgtcacccagagtggagtgcagtggtgtgatcttggctcactgcagcctcaaactcctgggctcgagctatcctcccacgtcagcctctcaggcagctggtgcacgccaccacagctggcttttttttttttttttgagacagtcccactatgttgcccaggctggagtgcagtggtgcgatctcggctcactgcaatctctgcctcccaggtccaagtgattcctgtggctcagcttcccgaatagagctgggagctggcgtgatctcagctcgctgcaacctccgcctcccaggttcaagtgattctcttgcctcaccctcccgagtagctgggattacagttgcccaccaccacacccggctaattttttgtatttttagtagagacagggtttcagtatgttggccaggctggtcttgaactcctgaccttgtgatctgcctgcctcagcctcccaaagtgctgggattacaggcgtgagccactacgcctggcctctaatttttgtttttttggtagagatggggtttcaccatgttggccaggttggtctcgaactcctgacctcaagtgatccaccctcctcggcctcccaaagtgctgggattacaagcatgagccaccacctgcggctaatttttttgtattttttgtagagacggagtttcgtcatgttggccaggcccatttgagatctttgaagatatcctcaacgtgaggtaaaaccaaactcctgactgtcctgtgctcccaaatgtgatctccttgtccgtaaggagctgagtcccttcccttggagagaagagtgtgccctttctctagatggctaaagaaacctcacagatagttcttttttttcctttttttttttttttttttttggtagagactcagtctcactgtgttacacaggctggtctcaaactcctgagctcaggcgatcctcccgagttggcctcccagagtgctgggatcacaggtgtgagccacaaagcggattgctgctggggcttgctgttctcccgtagctcccctgcagccctgaccctctgggcccagagccctttacttgttatttgttttaatagaaacggggctcatagcagggcataggggttcacgcctgtaatcccagcactttgggaggccgcagtggcagatcgcttgaggccaggagttcaagaccagcctggcctacatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccacatttttattttcttttctttctttcttttctttttttttttttttttttttgagatggagtttcactcttgttgcccaggctggagtgcaatggcgcgatctcggctcactgcaacctccgcctcctgggctcaagcgattctcctgcctcagccttccaagtacctgggatcacaggcatgtgccactacacccggctaattttgtattttttagtagagacaggctttctccatgttaggctggtctcgaactgtcaacctcaggtgatccacccgcctcagcctcccaaagggatgggattacaggcgcgaaccaccgtgccccccccaacattttcattttcatctcatgaagaaaagttgatagaaaaaaagccaggtggttggtacccatgtttatataaagatcctgtcacagactccataggatgaaactcagctgtgaaatacgtgggattaaaaagagattagagtctgggcgggcagatcacaaggtcaagagatggaggccggcatggcggcccacgcctgttattccagcactgtgggaggccgaggcgggcggatcacaaggtcaagagatggaggccggcacggtggctcacacctgtcatcctagcactgtgggaggccaaggtaggcagatcacagggtcaagagatcaaggcagggtgtggtggcccacacttgtcatcccagcactgtgggaggctgaagtggatggatctcaaggtcaggagattgagaccatcctggccaacatagtgaaacgccatctctactaaaaatacaaaaattagctgggtgtgtggcgtgtgcctgtaatcccagctactggggaggctgaggcaggagaatctcttgagcctgggagacgggggttgcagtgagccaagagcaagactccatctcaaaaaacaaacaaaaaaaagattagtttaaactttttatttgaaaattctcaaaattgaatggcataggccaggcgcagtggctcacacctgtaatcccaccactttgggaggccaaggcaggcggattgcttcaggccaggtgttcgagaccagcctggccaacatggcaaaaccccgactctactaaaaatccaaaaaaattagccgggcatggtggcaggtgcctgtaatcccagcactttgggaggccgaggtggatggatcacctgaggtcaggagtttgagaccagcctggccaacatggtaaaatcccgtctctactaaaaatacaaaaaagtagccgggcatggtggtgcatgcctgtaatcccagctactcaggaggctgaggcaaaagaatcgcttgaacctgggaggcagatgttgtggtgagccaagatcgcaccattgcactccagcctgggcaacaagagtgaaactccatctcaaaaaaaaagaaaaaaagtggaaatgtttgattatgtttaggttgaaagcagagttttgcatcagcgaaatggtttttcatgagaccgaaatgagcgtaaagcagaagcaagggtcaaggttttgcccagggaggacaagaagaactccccagaggacagtggggaatggagaggacagtggggaatggggaggaccgagaagctactcactaccccaagtaaccaggcgtatttttgtagggccaggtgcatgcccatattgattgacagggtctcactgtgttgcccaagctggacgtgaactcctgggctccagccatcctactgtctcagcctcccaagtagcataccaccacactcatctgcctcctttgctttttttttttttttttttttttttttttgagatagagtcttgccctgttgctcagactggagtgcaatggcaccatctcagctcaccgcaacccccacccttctgagttcaaaggattctccggcctcagcctcccaagtagctgggattacaggcatgcaccaccacagccagctaatttgttgtatttttatttttattttttatttattttcgagacagagtctcactctgtcaccagggctggagtgcagtggcacgatcttggctcactgcaacttccgcctccctagttcaagtgattctcctgcctcagctttccgaatagctgggactacaggcgctcgccgccatgcccagctaatttttgtagttttaacagaaatggggtttcaccatgttggccaggatggtctcgatctcttgacctcgtgatccgcccacctcagcctcccaaagtgctgggattacaggcatgagccactgcgcccagcccttgttgtatttttagcagagacagggtttcaccatgttggccgggctggtcttaaaactcctgacctcaggtgatccgtccacctcggcctcccaaagtaccaggattacaggtgtgagccactgcacccgcccctgtctttgcttcttaaggtgaaattgagatgactgaatcttagtacaattttttttttttgagacagggtcttgctgtcacccaggcggcagtgcagtgtggcaaaatcatagctcactgtagccttcaattcctcagctcaagtgatcctcccacctccacctctcaagtagctgggaccacaggcatgctccacaatgcctggctaattttttatttttttattttttgtagagacagggttttgctatgttgccaaggctagtcttgaactcctgggctcaagggatctgcctgccttggcataccaaagtgctgggattacagacgtgagccaccatgcctgaacaaaactacataaatttttaattttttttgtggaaatggagtctcactatgtttcccaggctggtctcaaactcttggctctgtcctgccacagcctcccaaagtgctgggattataggtgtggcgcctggcccgtacaaatactttttattctaggcttaacttttacattggccctagctaaatagaaatctcatcactcaggaattaatcctcatttaatcaaacgggtagggtgtaatcttaggaaattattgattgactctacctgattggatttgtagttaatagctaattaggttaataactaaattcacaaggcacagttttatttgatctcttttaaattgctcttaaggatgtaacaaagagtgcgtgggatgccctgagggcaggcattcgacttctggagcagcagcttaacttctgaaattcctccgaaccatgtgtccacacctcgtctggctgcatccgtgggccagatgtgggtggtgaatcctgtggattagaggtggtgctaggtagcccccaagtgactgcagtggtgggtccacaggcagcctgcagagcccgccctgcagcatgccagctgggcctgtgatggggcatccagagggtgttgccctgaacactcagcatgtctccgctgacacagtgtgctcaggctttgttaacatggggcctgttggctgcagagactcaggagttgagagtctaatttttggacctgctgatggttaagtcatagtgagtcagtgttaacgcgcaaagcgtttgacgagtccaatgtgcttccatactaagcagcaccaggtttcttttgctaaaattgaactcctgtgaaaaattcagagtgactaagttcattcaacaaagaccgtgggagcccgaggctggtaaacaatgagtccatcccgcatcccaggggactctggtggcagtgcagttttgccgagaggagttttaatttaaaaaaatgcaatcaggagaccagcaggtcctggaatgagtcaccctcagtgcatctgcggactcatcagacaccccaggccggcttcgggtggggaatgcactagaacgaagtgacacctttgactaaacgaggcctcccccgagtactcagagtggcccagacccctctcctcagggggctagcaggcttcagctctcatttgaaagggccgatatcaagcagagttgtgctgaggccagaaacccccacgggcaggtcctcccagggctgggagtgggcatgccgtggggccggcgctgccaggacaggagggtggccacgagctccagctccacaatgccaggccgaccctgccgtggggctggggctgggacttgctgtgctctgttggcagcagctgttcctcaggggtttccaggctcttggagatcagggacactcatttctcttgatcatggctgatacaagcatccctctctgtgtcaggtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggtcagacattgccctttttccccagcctcaagcacaggggacacagggtgggctaggccagagcgccacctcctcagagaggcccctgggctccccactgagcatgatgagcctgggtgaggggaggcgcctgctgcggttgccccgggtggaggccgcatgtccggtgtcccttggtcattgctggtcttcgcctgggggcgggctggtcaggagaccgattgggtaacactcctgatttcggcttctctgaaacatgagaggctgcagtgctggagccactgcccagggtccctacctgcacccctgcctggcttgtcacatgctctgtgtccagcctggtcatgcctgtccttttccccacctcccctccgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcaggctggctctgagggaccctggctgtgcaaagctggcggccactgcttgtggcgcctccagactgaaggccaccatctctgagtgggcgtccattgttctcactgggactgtctgcagcggggctgggcctcccacagtgtagggatcagtgtcctgacactgggaagtgtgtccacacgtctgaggcttcccttcctagggaaaggtggccctgggaggctcctttgtgtgcctctgctccccacaatcgtggtgggaaggggccgctgggggagtggcagccccggcatctcaggctgcttctggacagagcacaggctgtgtctccagtaacctagggagcccttggcattcatggggccagtgacccgtgcccagtgtctcttgacccttcctcacagcaacctgaggagtagaccaggcctcacctgaaatctgtgtcagggttctctagagagacaggactctatatgaagagtatatatgaagagtttattgggagtattgactcacgtgatcacaaggtgaagtcccacaataagccatgtgcaaggtgaggagcaaggaagccagtctgagtcccaaaacaaaagtagagaagccgatagtgcagccttcatcctgtggccaaaggctgcagagcccctggcaagccactggtgtaggtccgagagtccaaaagctgaagaacctggaggccgacgtgcgagggcgggaagcatccagcatgggagaaagatggaggccagattcagccagtctagtctttccacgttcctctgcctgcttgtatcctggctgtgctggcagccgattaggtggtgcccacctggattgagggtgggtctgcctctcccagcccactgactcaaatgggaatctcctctggcaacaccctcacagacacacccagtgacaatactttgcatccttcaatccagtcaagctgacactcagcattcaccatcacacctgggaagcatggaacccagaaacaagtgccagggctccagtgccagtgcctgtcctgggaagatacccaagagaagacatgaccaggaccttgggggagcatgaaatggtgagggcacagtgagcttgaaggctgatgtcacctgccaggagagcggctggcagtcctgcctggtgccccccaaggggcagagctggcagagaggggcctccaatcgaaggccaggagtcgtggagctccagtgccttggtgtggctggccttcttgcccccctcccagaggaccccgccagtaacagccctgctggtggaaccttccccagtgggcatgaaagaaatgagggccccacaagccacatggactctgatgcctggagccaagaataccccttagggtggtagaaaccgcccccggggcactgtgcagtgtggctggctctccagcatcaggagtactggggattgcctgggggacgactcctagggctgggcgcccgtgggccctcccctgctgccactgcggcccacgcaagccgggcctgaagggcgcgagcggcatgggtggggagcttgagggggcgttgggctcccaccaagcgccagatccttgcgcgcctccagcgctcgcccgcgcggctggttcctttgggatgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtgggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtcccactcggtgaccccaggcccctccggcgcgggatggcgccccaggtctcccctactccgctcaccccgcagttaatggcaaacgaataaataaatgaggcggcctcggagtgaggggtgctggaggactggcagccaggccacgaggggaacgggacctggaaatccccaagcctgggtatgagaaggcagccgagtgtgcggcggcagggcaaggttggcctgggccgcccagaggtcttcagacccaggggcgaagctggccacgacccagccccgcggtgaagccgcgcctagccttggtgctccctgggggaagtgcagggccacggctggcccggttcccagtgtcctcccccagcccttcgctccccaactcgagagccaaatctgtgagggcatgggctggagcccctggctgccttcctcttgcccccatcccttctggccaggccaagtccgagggtgcaggggcaaggaggagagttgggggcctgagccctggctccagaggcccagagcatgcctccccagagctgaaggtgggagatgggtaggttctccctccgccgttgggtgtgactccggaactggcttgggctctggcctccaatgctgctacggggccaggcccacctccgggcccaggcagcagcactgcagggcctttctaccctccccaagcctggggcccaggcagcccctgtccagcaccaatctgtctatggggaactggctggtccctctgctcaggggaccccgcagtccagggttctgagtgggagcattggcaccaccccactcctgaaagcgggggcctggcaggatgaggatggcctgtgccccccacaccttggcccctggctcggagagcagggtgacaggctgccttcctgggctgtggagagcctcgcgtgcacctcgcctccagctcctgtgctgggtcgtgaggtcgacctcacaacagcagaggacaggcccatggggtgccacatgggccaggtgctgtagggcagaggccattctggagaggaatgtggggctgaaaaaagtactgatcataagcctcattttgaatgcggcgagaccaggcaatctatggcctccctagacacctcccggaggctgcagtaagaacctcttcggcctctgggctgctccaggcgggccgtgacaggggtgtgggagacagagatcccatggcccctggaggggccaaggggcaaggagcctcagctctggctctcctccttattctagcatcgcctgctacagggggtggccccaggctttggagggctggaggcccgggtttcactcactgccaggctgcccgctgcactcccggctgctgggtgcatggtgggggcagggccaagagggtctccttgctgagtggttccctggtccttcccagcagggctgggagccccgcgcagcactgccaccaggctttattcggttgtaccaaagagatttccgtcagccatgtacaaacagaacagagtccataaggagagtggcgaagctgccgggaaggaaggcaagcgtgttttcctggagccaggcgctgggtggcaggacaccgtgttggggggtgcccagtgggaggtggtgtggtctacacccagagaactaaaggggtgaccgcagtcactgctccctaaagccctctgctctgcacctcccgccacagctgggtgggcagtcagtgtggcctctgtccaggtggtgggggcatccggggaccaggtgggggcgcacgcaggagcggtgcgtttcaggctgcaggtgccgtctgcccgtctcacttccggcctctccactgtgctggacaccctctctgagcagctttgctggaaagagcggagagcctgctgcaaaccaggcaccttgtaggcaggcaaggaggcagagtcctcaccagcccttccagagccaggccagttagagagggcagccctgcagagtcctatgtccaaacgcagaaggcgcagaagcagagcagggggagggccggccagggcctctgccaggttagaagtcaccatcgcgctcccccaggggctgtgccgcctgctgcctggcagcctccaggaaggccagctccttggcttccttcttctggtttcgcgcctcatactccaacctgagagggcagggtaagtctagcagagagcgcccatgaggcggctccgagggggagggcagggtaagtctagcggagagcgcccatgaggcggctccgaggtgcccccacccaactgcacctgttggtgatgatccgctggacgatgaggtctgtggtgaggttgctgccactgtcaatctgacggaagatgccccttctcttgggctcctgggggtccagagaggaggagcgggatgaaggtccctgctgacctccccaagacccatctgatgccctgccccagagggagaccagcgcccagggtcccatgggagtggtgcagtcggagcagctgcgccaccatgcccgtttcccaggcaggcacagtgagtcattaaatggctgggaggtgccaatggcaacccctgtgcccagcaagggccagcatgacccacctggtatgggtcggagccatccctgtcagggataatttctgtcttgccgtgacacaccaggtccacctggagaaggagtggggtcaggagccctccccggggaggcagcggccgtcgccacccacagcccagcacaggccccgggggttgggagagctgaccctgccctttcctcagcccaggtacctcctgggccccgcctaggagcccacagccagcctgcattcccagcccatgcaggaacagaggtgaacagagggaacgaggtgagcccatgcggagcctcaccttgaagtgacttaggagctctgctgtgaccgcgtacggggctccaatcaccacttctgacacgtactgtggggacagtgggggcagaaagacttgctcggtccctgctactggtaagccagggccacagggtggtgagagacggctcagacatggggcggggctgccagtgagtagcagggatgggctgggcaggctggggacccctggggctcctccatgagacaagaaggaacagcatctggagacctgaccacccctcctcatgcctcaacaaacaggtatgggcaggtgccacagaactcggggtgctgggtgcagctctgccagtgacccaagcccccctgccctggctcagggaggcccttagtaggggggatgttgtgggaatgtctccccatccttgggctggctcctggcccccactcacccggcaggccagcacgctcagagtccgttcatgcagattcatgatggggtagttcttccccttgtagtgattgacctcctgcggccagagtgcggctagctcagcccggagactttttggggggacagggtgtgcccctcccggctgtccctcatgggaagaagtcggggaggttgctcgcccttgtggggatgccccagacaggacagccctggaccccagaagcctacgatcaccccccagggtctcctgtgacttcacctggggccccttcccagagaccacctgcacctaacagcaacgcttagggcccctcgagggcccatcagctgcccaggggcccagggagcaagaaggcagtgacctggtcaaagtgtaagcccgcgatgatgtagggcctctctgccagcctgtgcaccttctccaggaagtccacatgcccgatgtctgcacccaggttaagaagcagtcgggatggggatgacagggagcagctccctgacagctcatgcccaagggcctccccgccatcctccctgctgacagctgctcccctgcaaaccagccagcccagtctgggggccccaaggagtcaagtgaggcccccgggtcccaccccatgtggcacatgtaggggagcagcagaggcccagaggatacggaacaggtcgaaggcaccagccacatagatgactgtctcccctggctggggctccttcccagaagcaaactggatgatcttctgagatgtctgcaggaactgggataccccggtccaggggttccgcccaccagggcactgcaagccaagagagggagcaggttggcgggggaggcctcccaggtgctgccctcaccaggtcaccaaaccctcagctgtcacctgccagcaatcccatttccagccagtcatctcgggcaggggacacactgccaggccaggtggcaggtgggactgtggcgccaccccacaaccacagcaggcaccgcagcagacaccacttcagcccagcaagcgaccaccaggaggaggcaaggagccctgtggcaggtgcacacagcccttgggagggacctggtaccctgagaccactgtctggtcacctgggagcagccttctgaggaaagtatgtccccggcgggtatcgggtgagggggctacaatgggagagagggccaggccacttggttagaggccacctgtccacaggcaaatccttgctcctccaagcagtggctgccgtgaccggccagccggtgccaccacccgcctgccctccctcccagcatccaccagtgagccaaacctggcagtcagtgcctggtcagtgccagggacagagggaggagggtgaggctctgggctggcctttccccaagggatggctgggacaggtggccgggggagccccctgcagctgcgtgctcagctctccctgcacagccgcactcaccttgccaaaactgtctgcatactcccggtactcagaggacatctcctgcacagaaggtcagagcagggctgaggggcctgccctcccggcgtggccaccccagaaccggctggggatggggagcagtgggcaggaggaccctgagagggcagggaggtgcccctcctttcccctggagacctcgacccaggggcctcggggattccgccgccgactcacctggctgctgtgatgggctttggttaccagcagcatgcggcccacgaggtctgtggtggacaccccttgcgtgcgcttgcattctctgggggacacagtgggagtggggtctcatcctgggacactcgcaaggctctgcctcctgctaccaccactagggacactagcagccctgctgtggcagaacccacggctgccccaaagactgagggtccccttcctgtgcaaggccataacagaaaacctgggttgggaacatggggaaggcctccacgcttttattgactgaagggagtggcaggagcacagaaaaggacccttgctggggcccaggtgtgcaatgccagggagaggatgggcactggggtagcagctctgcttcctgcctccctcacacccacgtcctgcccgctgagcatctgcagctgagtgaattctcagctgcagcatctcatgcgggagccactggcctcatgtccctgacgtctggtaattcagatatagtgccagctccccagcagtgccagccacgtcccccgagctcaacagctgccacctcacaaagctgtgcctttggagccctggggccatgggtctgcagcaccaaatggcaagggcctccaggccaccccacaatggcacctccatccctcgagttcccagtcctgggcgtgaggaacatggcccagggcctggacgctcccctcacgggctcccggtaaatagcaaagcacgagccaggagggagccccgtgtccagctccctggatggccaggcccgcggtggagactcacctgtacctcccagcctgctttacttcctcataggtgtcccggccatctacagtcagggtgatgtcatctaagcagtgacacacaaggacaaggatccttaacccaaagccaccagaaccttcagagcccaggaccctctcggcccctggcctgccctagtgtccgcgtgcccatttctaggtgggggcccggaaatgtctcagatcctcaaagggcggaggccccctgttcccggatgtcccaccagcagatctgatcctgagccacctgatgtccccaggcccccaggtcccagccccgccactcactgccgtgaacacagaagtcacagttgtatttgtccagggtctctagtgtagtgacgtagggagccgctggcaccacctcgtccacccatttgatggcctgcaccatcttgtatctctcctcctgagtgaacaccgggggccccttgtgcttggcgatctcctctaggaaaaggacaacggggagactggggaccccagcccacccggcccctccagtaggaggccccttcccagcacccagctgtagccacacaagagggccggtgggggcaggctgtctctctaccctggcccttagcccactagtgctggccaactgggtggctctcttccctgcgagggtctcaggcaaaggcagagattccttctgacgagcaggtgctcagcccctgaaggcttgggagcctcgctggcagtggtggggagcaggtgccccttctctttagctgggacaggaaatgcaagatgggaaaggcattaggccatcctcagctggggctgggctgggtgagcctacagtgccctcccctacagctgtgccctggcaaggtggccccaggcctgcaggctttcagtcaacagtcgcaacccacaggagggctggggggccgcgggtgggcgaggccatctgtgcttaccatcggtgtgcacgcctacgatgaggtagtcacccatggcccgtgcctggcgcagctggttggagtggccgtaatgcaccatgtcatagctgtggagacagagagagtgggtggtccctgtgccaagggtggggaccaggtgtccctgtgggttaggggcagagctttgctcctctgaggactccttaggaagcgctctgagaagctgctgctgggagccctgggactgggattcggaggatgtaggtgctcagctctccaccccactggctcctgggcctgacggtgggacccctgtgccagatctagaaagggtggcaggggcagagatgtcaaggcctggctgggtctagaggactggtgggtgcaggacagactggagcccactgaaagctgcagggccacgtgtcctatcccctcaccaaatatcaactgccctgggcagtcactttaaaataagccgatgttaactcttggggtagggttggatcctagactaccttgagacaagcaaacagtccctggggctaacccaaaacaaatccaaccacaaaataaaaccctgggaatcactggccctgaaaatcctgtctctcctcccttacggcctcaagctcagcaggcttaacgctaagggtgaacagccactgccttgccacctggctcgagagttttcattcacaaatctaggtctgctaacacgtgaactctcaagcccaaagctacacagccctgccaccaactgggcctcgctgccctggcttcttcgccacttctttacagcagcggcccatcccctcaagtggacaaagctgtccctgcctctccagggagaggtgtgaccctggcagcccacacagtgcacagagttgctccactgcacaccactgcttcctcccagcacccctgccacagtgcgcggagcccggcagacatgctgggtaaaatctggcgggcccatgtacccactggacaggctggaggggaggagggggcagaggctgggccaggggagcacagtctggaatggggctggggcctggtcagggcaaggtcaaagtccactgacacaaagccacattccttttcccagaggtgactcggacacagaagacaaggccctgcttgctctcctgggaagggctaatcagatagaggcgcttgcttcctggattccatccggcaggcacgtgaaagggtcagaggtagcaaattatcagtaacggtcgtcttcctttcacttgttgacaacccgaaacttttcttaaaacaatgccctctgactggccagggaagaccgatcgcattctagccccgcggaggaggacccgggagcccgcgggcttcaccgcgggtcccggacaggcaggtcgcacccgatgcccacctacagggacgctcgcccggaggccaggggaacccctggaccggagccgggcaagctggttgctggtggttacggagaagcagggaggccgtggctccagatctcagcgcggtggctgcaccggagaggtcggcgtgaccgggcggggcctccgccagaggtagacggggtcgcccacggcagggcgcggagcctctgcagcccgaccctcccggcaggcgagccccgcagcctgccagccccggcccatgccggacgaggacgccacccagaacgcgggcccggtccccgggcaacggctggcgcggcgccccggaaggaagccggccccggcgcccccgcggcccgccccggccccgcgctcaccagccatcgcaccacaccctcacggcgcgcctgccccccgggcccggctgctctgcgccgcctgcagccccgcgcccgttccggatcatggccccgcagcggcggcgcggacagcctggcagctcccggcgactccgagcgccgccgcccgccccgccaggcgcacgctcagcggccgtcacgcgggcctcacccgctgcgcacggccaatggcgtgcgccgctcggcccgagccccgcccccgcctcccccgccccgcctcccgccctccgccccgagccccaccccccgaaggccgcgccccaccgcacctccgcgcacggccaatggcgtgagcccctgacagagtcccgccccctccaaacgcacagccaatggcgtgtgccgcgctttccgagccccgccccccgacccacacctggcctctccgcaccgcccacacctggcgctcggctggcggggcagtgcggcgtggggaccgtcccaccgccgccacctccgggaacctccacggggcgctgtcccaaccaggggagttttttttcttattttttggcacaataatctacagttgtcccctgtccaaccaagggagttttaagccacgaccgagctgccaggcggcagacctgagcccggggagcccgcgccgaccactcggggacaccggaagccagtgcagaaacgtttaatagaaataaaaaggtctgcatagagccgaggctcggagccacccctctgccgcacatccagtacagagaggattctataaagttcacactttttcattaagtagtagtagaaatacggtgaggccctgagactggcctggtgagcgaggaaaggccgctgggcgcttccactctgcaggccggggctgaaataacccgagttccgttctcacagaaaggtgcggctgccacctcttgacacagaggccggatgggcaggtgtcctcgatggccaggccgtatcagggtacaaccgcagcagtgcaaggggcttcctcaaggacaaatggctaaaaatgtcacggtgaaaatgtcatccccaaagagttcgttctccctagacccgtgggggcaacccagccttcaccgtgacactggccatctgcaaagtgccaactgttcttcatcgagcacgtgattacgtcactttcttcctttttgtgcgttttgtgcagcccctgccaaaccagccccctaggatgggggccgagctaagcggtgcaccccggtccccaggcggggcctcctctctgcttctgcacagcgacttccgactgtggctgccttcttcaccagcacgcaggggagtcgccagtgagaaaatgggatcctgccacctgccaaaaagggaaagcggcatcaggcgggcctgggagcctctcgcagtcacacctgccccagctcgggaaagctgtctgcggtccctgccttcccatccccttccctcccgtgtcaactgcggcggggctctggttggcggcagcttcattgttaccaagctgcagaacggatgtgggagaggtcacctcttaggtggtgactcaaaggtcggcacccacactagctcggtctcctcaaaactccgtgtccttgtccaccactgagcggcgtgcacacacagggtggggcagcagtggccccagggctgcctccgtctccagggatgagtcactagcaactctgggccccaccttccacttgtaccgctggggcaggtggaccagaccctctcccccttcccagctgactagggaggcgtggcctacagacgaccccgtgaagaaagcatgtgtctgacggagatgcagaaccacagatcataacttaagatacagatacgcactgataaggaaaatgagctaagttaatgtaaaaaaaaaatacagtacacgatagcccacatcacagaacaccacacacataacatacaagaagtgccaggcccagaaggtgaagggatccttaatttcttgaaccctttgattaaaagaagttattgatttcccctataagaccctgaaaattcacagagaaagagagtgtaaactttttactcaatacatacaccaagtctaaattatcacaaattctgtattaaggcacagtttgtttaagctttcccaaagtacgccaactcccaaaaccaagcacacagattctgtctgaccagagctgccgagtgctcgtcccctccagatgcttcccaccaggcatctcggagagctccacggggaggcctggagcaggagcacgcgggcagaatccctctccccgcggggattgtgtgtgccacatcagccagggcaggagtggcacacgcagggtctccgccaaccaccgaggtcaggccctctggagaccaccacgcttcagtcatgcctcaggcaccactgcaaacacctcagagcttcctccacactcagctcacgagagaagacagacaaggcccagcacacagaggtgcggggaagcaggctgctgcagcggctcactcacctgctataggcggggatctccaagcccagctcggccatgaggagccgcatgacgtcatcacacttcccatgtagcttcagggcagcccagtcatccttcggggtccactgaggacagggaaagccgagtgagagtaacagcagcccaacccttcccggtggcctgtcagccttggcccctacgggctcagtcggtgctccctgagcacccacgggggccctatcagaccgccctggtgcatgggtgtggggtgtctctggctgtgcgttctaagacccagatctaaggacgtggctctcagcacccgagttacctgcaggttcacgatgtaaagcttcggccgccggctagggggcttggtcatgcaccagaggcgtgggtacttctttagaacctgtggaagcagacagacagacaccgcacacacacaagggacaagtctgtacagtgctgggccgcagagctggacaccctcgggcgggcaggggctcggttcactcattgtgtcatcggcacgtaccttcaggctggaccctagacacaggatggtgtctgctctgctggcagcctcggtcgccgcttcccagttcagaggctgccccaacgtccccctctccccaaagtgcacaatggtgtcccgcagctgggtcccacacttgtggcaggtccggcctgtctggtgtctgtggagggcagtgcgctccgtcacatcgaacacccgcacgtactccctgttgggaacgcaggaggtacagacctagaggcaagagggcacagtgagtgggacccgcctgcccatggagaccctgggtccctgcaggactgctcacttcaatgtacatgttcccgtggagctcggagatggccgtgcgcggcagcccactcctcaggtggagcccgtcacagttctgagacaccacatgctgcacctggaaggcagaacgggtggcaaggggagggatggctgccagtggtggtggggaggtcagtacccggccacagcgaggctgttctgagccccgccgatggctcccaaaaccaggggcagctccgtccccccagagagccttagaaagtaaaacacacaacaggtccaaccaccaggagtcaagagggcctgtggtggggaggggctgtccttcctccagccctgatgcacctggagtggctgggagggcaagaggttgcaccgtcccggcaaggttgggaagtggctcggggtttggcaagggccactctgccccagatccatgctctcttgggtcatgacatttcaggtccctggggacctaggcagatcaaccactacaccccattggttgagggtgttcagcagaaggtccccagagatgtcctataagcctcccctgtgactaggatggcttctgaggtccacagaaaaatgcaagggaatcacaaaggggaaaggccaccagcagctctgaggctgaggctggctgcggatgggatggttcagagggggagctccccttctgtcctggagagtcaagcacaggaggatcaaacccgcggcctaacccgcttggtgggtgctcatcatgggagtcaactggcagacagagggcgggtgcagttagttgcccactgggcaccaaggtgctctgcctggtccctggcaagtgtaccagccacccagggctcttaccagcttctgctcatgcagacgggtgatgctcatgtgggtgagggttggctcggcctcgctcaggtcggcagcactgccaggcagaaaggaaggcaaggtgaggagagctggagctcaggcccgtgctgccgctgcccagcctatgtgggaggccatgcctggcccgcttacctaacgcttctccctttctgaagcagtgtccacactccattagggccccggtagtctgggatagacgctgcctgcatgtcgagaaaaaaggtaagccaagtcaaaaggcaccactgtaggtactggcagaattcccagaaacggaaagccactgtcactcctgccgcattccgggctggcctgcatgttggcctctattcattccacaggctgacctgcctgagcccatatggagtgtaccccaattcggctcctcccttctacctggacttccgtttcccgcctggcctggctcatccttccaggctgcacgcagccctgcctgcctccggaagcctctctggcaccgagcacaaagctgggctctgtggcacatgtgtcctccacactgcaggggaagactagtcatgttcctaaagtgcccccagggccgagcccacagctcacacatttagcaaatggtgaatccctaggtgggtccaggcgactgtccattctcatgtcccagtgctgactattcccgctccaccttaacaaaggcagaacaacttcttcagatgagatgagcatctaacttcccaggttttcaatcctgtgaaacaaactgaggcccacagagggcacacaagatatgccaggatcaaggtgtcttgtgttcccttttggggactcccgactcctgcttaaactcagaaaaatgcaccacccccccggacagtagttccgacagtcacattcaagacgggaacctcaaacactccgatgaaatccactagctgcatgtgcttttagttgccattggaagttccataacaggtcacgtgactgttacataattacatgactggacttttttttttttttttttttttgagagacggagtttagctctttcgcccaggctggaatgcagtggcatgatctcggctcactgcaacctccgccttccagtttcaagtgattctcctgcctcagcctctcgagtagctgggattgcaggtgcccaccaccatgcccgactaatttttgtatttttagtagagacagggtttcaccgtgttggccaggttgttcttgaactactgacctcatgatccgcccacctcggcctcccaaagtgctaggattataggcatgagccaccgcgcccagcatgactggacttttacatgtgacttgtggagggaggagactaaaccccagggctccgggtatttgagtcagtagtgaactccctttttgcattcttgctgctgagcctctgctgttctttgcttggagtgcctcattccaaccttctgtaaatctcacccatccttcaaggcccaatcaaggccacctcccacaaaaagccaacgcaggtgggtttcccaactccaagagcgcagagtgtgtgtctgagtttgctctagcgacccagcacagccagctttacagtatggttatttgttcacatgcctgatccttgtcacctaaaagcttcctgagaacagaaatcacctgggttcagatctgctaggccgacgcgtgcccaacaccccacacacacccatcaaattagatggacgaggtgccagctacactttcaaagctagtgatgtcccacagcccaggataacttgtcagtgaaacttctcaaaacacaatgcaattctctccttcacctggtgtattctggctcttactgtgtcactttctacttatcttccctcgacatggacagaacagagtggaaaatcacaactttgggcttagctctgtccacataacctgggggtgcctgcgagcagtcggctactacaccccattcgtatctctactccttgttttttttaactggctgtaacacagaggccaagcgtttaaaaagcgtttaccttaggtaagttttggtcatttcgtttctttaagagaaaaaaccttagagctgctttaaaggcgagtttttcgcgattactggagctcatactccgtcctggggtacgcctccgcctccctccctaccgtgctgattcccgcgcctgtgtagacgaccaagtatttggcgttccggacggcgctggccagctcccggaccttcccccgcagctcctccgggtcgtcgcacacctgccaagacgccagggtggtcaccgccccgggccgccccacccgggaccgcccgtcgccccagctgctcccgaaaccgggggcgcccgcgcgccgcacgcggaactcgcctcctcctgccgccgcttcaggccctcgcgccgccggctccggccctgcagctccgttaccaggtccgcgctctcggccagcagccggccctcctcggcgctgcgctccgccgccgccttcctcaggatgcgcgacacctgcgggcaggcggacggtgagcggcggcgcgggccgggcatggccgggccggggagcggcggcggcgtacctggcggaggcgctccctctgctgctcctcccgcaacctccggacccgctccgccgctttgcgctcggagcggctcagacccccggctgccatcgctcccctggagacctgctcttccgcttccgcctcacacggcaggccgcgctcagggcgcatgcgcaagatgggccccgcccccacccaccccttccggctccgcccgccgcgtcgccccaaagaagcacctgccagtctctttaaaaggtttattgatcatatacaaaataaagaaaaccttatatatcacaaacatacactatgtacagcaataaatacccggggggccaggcccagtgctgcccctcctggacaataatttagcaataaatactgcgcagggcaggggtagggcaccaaggccactgccctgcaagaggtcaggcccctgcccgccctacacgaagtgtgagcgctcgggcctcaccccgcatccaaaccccagcccctcctcacttagatctttaataacctccatcccaccccagcagatcccggggtcttctcccacacacacaacctcccctggctagacctaggcagggcaggcagggactgatcaactctgcttggacccacctctcagcgccaggagagcaacagggctggacacgcgggcagcccttgtcctgttgccaggagaaggctttctgtgcccactcccgtttggttaaaggcttcagggactagcagattgagggggtgggaagaagggcagggctgggacacaaggttgctggaggggccaaagcccaactggggtcaccaagaacagggaggtctcacagtttatcggggacacactctagctcagactcaagggacacccatggtatcaaagctgctgctccaggggcagggtggaaatgtgtgggactggcccagcaggtatggtacacacccaggacacaggccagaggcaggacaggcattagtctctcagacacgccctgcctctgtgtggcactgattatgtactctactctcccgacctgctccaaggccagacagccaacaggaaggcaaaaatacaccaaaaagaattattcagtggcttctgggggaaaaatcgttaatgtgttggttcctttcaccaaaccacagcctaaaaaagtaactcacaagatcccagagcggaaacggtgcagcaggctgcggctccgactttccagatgtggatgggcgctttggccaagtggccactccagagggaggcagcagggacaacatgggacctgaccatcgtcccaaagcaggctgcagccgctcagggccgtgggccgggccctgatcaccagtcagaagtgtacacacatatctgaaacatgcaccaagagctgagccagcaacaccagtgccaccccgagcagcagccaggggcctcactctcctggtgagagctgacctgtccctgctgggtattcctctgaaatctgagcgtccatgttaggataaaagaggagttggggcaaagttaaggtggaagggaagacatatatcatggtttacttggcggacaagtttgagagacctggccttggccaaagccctcgattcgctgtgtcagaaaaactgaggtgagaagagaccaccaccctctccaccaccctctcagtaggaaagcgggatcaacagagatcagaaggacagcacactcacacctgcacatgaacacaccatctatgtcaggaaatccaggggaaggggaagaggggtggagtggctccgcagggctgacctgacaggggacaggaacactcccctagacccagggaagtcgccccaaatccaaagctcttgaaaggaggtatggcctcgaaactccagaagcctcttctgccaacgcaccgaggacctgcacctcccattcagcacgcgtcgacccttacaccctcctcttccacactcccttcgcctccaggtctgcagcctggcagaggtgctcaaaatggatggccacccacagccaggacaaaagtgggggctgcacaaggacaaggagggcctgtttctccccactccgaggcagatcatgacgttttcttcatggatacttatgatatgattccaactaacgcctggattctacttagacaagatcagactgaggggagggggatgaagtcactaaatgacaagagtcaacagccaatatttccattttcaggctgacgcaggtagacacaggacttgtctctgaacacctcgagcaaagaaaagctcattaacatgacaagtgttgatggtgcctccctgttcccatcctgtgggcacaccaggccaaactattggataaaaatcccaccatccatagggttaagccctgttgggccacagtttttcatcttacccacatctgtgtgctttacagaagtctgggccccacagaaaagaaaccagcaacccggtgaaaggccagggctcacatggccagacacagggctgtagcctcttggaggtgggtaggggcaccccctccccatcatatgcctacaaggagcctcctgagcccagccaggaagggcagcagcctctggcgaggaactgagagcaggaggcaggctgcgcccccacagggaggcacctccagcagaagccaagcagctgatccctggaagacacagatcccaaagggaggcagaaggcaggcccgaagccaagagctgccagcgtggaccagcggagaagagggacaagacccggccctggagactgtagcccttgtctgcactggtggagacccccaaggctctcagagtgaggcagggacaaggaagaaagggcggtgcccggtgggcccccacccactctgcctggaagcaccacccgcagcatggaaacacctcagggatcaagcgggcggcgagacctgcagcccacggcgcgggcagcctataggaacaaagctgaggccagaggaagacggccagggaacgcttggccatagccctgtggccacccacagtgactccctcatccctgtaatgccaccacccaaggccagaggtggtgggtgtggaagcagcgtggggcgccccaagggaccccagtttcacctaccccgccactagatcagcccaagccctagacacagatgtagccaaggctcagtggaggggggcatgacagaaccccatgtctcacctcctacggaccaggagctggtggtgggcacagattccttgagctctgacgcagcaggcgccacttggcaccccagcccaggtccagcaagccagcagaagcaaaagcacaactaaacccaaaaaacgaacacgggaaaacagacacaagaagtgacacccacaggtcaaaggtcaccagaagcaccagcactttaccgctgcacaaaacctcaccaggcacggacgacaccacggcaccggcaagagacggaagcaggaagggcagaggagtaagtcactttcggtacaattgcaaaagatatcaaagaggacggccttctggtcggctcacggcttggcttttttttttttgtcttttttttaaactaagttttataaataatgtctgataactctgtgtatataaaaactaaactccaacagccacaaagaggtgtccgtaagtttacaagaaagggattttttttctttttttttcttttttttttaactagcaaagtttctattatactttcttcccttttccattcatatggtcaaatggtcttcttgcttgttttttttctaaaagacagttttataaatactctgcagctcttttttctttaacttttaaacatataattaatttaataactttgtaaaaggaacttctctcttttaaataaagggctatataaccacacaaataggtcatgtaaacagtgacacgggacccatcgcagggcacactggacccaccctcacgttaagcgcacaaccagcgatttggtcttgttcagtgcaacgggtcaggcctgagtgcacagcccctgggcccagctgcacgcccccagcaccactgcgcccaggctggtggtccacccatcagggccttcaagcccgccctactctcagagcagagcccatctcttcatgctgggctaagctgagctgctcccctggggctaaagagagtgaatccttcccagcccgcgagcctgtggccactcgggagtggagggaacactgggaccctcactgctcggggacacgcgaggcccagcgtgcctgctccttctctctcccgcaactctctctagtccgttcccacagcaccaactctggactccaagcctgcatggccctggtacaaaaggggttggggcgaccccacgtcaccgccgaactgaccaatcccaacatacaaaacacacgacgacaatgacgagatcaaaggggctcagcccggcgcccctggggtacaggttgtgctttgcagggaagagagaagggtggggaagagagggaggaaagagaagagaaggaaacagagggacagggcagccaaattcgccatgtgcctagtggccccgcaaagacccgcctgggcagacgcgcgtccctacgatcgggcatccgtcttggactttactattgtgatgacgctggtggcggccaccttgcctgggacgaggggccccaggccggcggcaagggggccccgggctggcgccacggggctgcgggccaccgtccgggcgaaggtctgcagcgcctcgtacttggagcgcagcgcgtcgagctccagcttcatgctggcgttctctgaggccagcttctccacctcctgctgcagctccgccttctgcttctccagctcctccttctgcgtcacccgcttcacgcggcagctggcagcgtagccgcggttcttgagcgtgcgccggcgctgcttcagctggacgatctcctccttggacaggccccgcaggtgctggttcagctcccgcaccgacatggtcaccagctcctcatccgtcaggctggtgccattctcacccggctcccgcttcacctggggcacagtgcaggtggtcacaggccaagcgggcacgcccactgtgccccccgaccccagcccacaggctcctgtccctgcccactcaccttcaaggccttgtttcctttattgggggtcgtcataacccgggggcacagcgagcaggcgctctctgcaagacacggagcaggtcagtaccctggagaccaccctcgccgcaccccccccccccccgcccccggcccagttcacaagagcccttgccgcacagcccgccccagcctgctgtccaggtgcccagcccccaatacctgataggaggcagcccttggcctctcccaggctgggctgagctgcttcctgtccaccctgcccctagagaaccaggtgggaggtcaggaaggtctgacgggagaaggggaactgaaggctgttaggaaggcaggcgcaagacaaggggcgggggagagattagaaggaataagacgcgggagaggcaggcctagaaggaagccgggagctttaaaaataaccccggcactgcccagagcgcggctgttcctggcgagtcacgctgactcagcacattgcctctgcctccccgccgcgcccgcactccctggcccgccagccaacagcgccccacgagagccgcagcccccagcctggccaatagcaggtgagggccagccagtgaccctgtgtgtgcatcttccagggtcctaccttctacagccacctcccctgagccggcctcggacaaagccccctgctccctgggtgcacaggggccccacgggggacctggccagagaggaggctacagggaaccccgagtctcccagcctcctaactttgaaaagctgggggtgggccgtccatctagctctggtctgttggcaggactgaccagggagttcccccaccttccaggtggcaggccatcagctgggaggagcctggcccgaggcccctctagacctcccagtcggcctcctccactgatggagtaaccatcctgtggctttgggttgcaggaagcagcccctgccccaccccatccagggtatttcacaagggctcccacagtgagccaccccgggcctgcccaacgtgaaggctggcggagtcagcccctccgagctgcagcctgctctctggtccctgccccgggtgagtgcccacagggccagggagcaaaaacaaaagtgctggggtggccggacttaacaaccaactcttccccactcggggtccctccagcactctgctctcactttcttgctaaggatgtttctgggattcccagctcagcccagctcccaccagacccttgggcatggacccccgcctcatgctccatcccccactttccaggtttgatgcagacagatgggagactcctccagaggagctaggatcacttcaggaaattatgggctggggggcttcttactctcatcaggggagctgaagtgtggccaggcggatgcacacatcctcaccaggctcaagactccacctcacccagcctgggaccaggaggtgaggctgcaagcacagagcagggaggggaggccagagacccctccccacagccaagccagctcagaggcaaggtcccgaggctccagccactggattcttccagataaaggatggggaagacctgagctggaggtcagaaggcccacaggagccctttcctacacgtccggcacaacactgccccaggagacaggccctcagccaagcatggaggggccccccagccttgagtgcaagtcagggtgcagagacactgccctggcaccagcttctcccacccccatcgcccccacccctgctgctaagcacaatgacagtggtgacttcctgaagagatcacacggaaaagtgcctcctcgacagattttgccctccgcagaaggcctgaactcagcacaagtgcaagccatcgcctcctatcaaaggtgcgccggggggtgggggaggggcagccctgagcacagccagtgcgttccaggctcctggcctggcctctggacctgggctgagagggaccatgcagggatcccaggagctggactgaggagaagctgcccccgccctcctccagccctcaaggctgggcagagctggggcctgtcatgcaccctctgctcccagaggctaataagcccacctcacgcaggaggcacagatggtcacggctccgcaacctgcgagggtacctaggccacccattcacactgagagccaggaaagggagggagatttgggagctccgtctcctttggctaaagtagaaactcccgtgcctgaacacagacagccccacctggctgcaaagcccagcggccgaaactccccggcagtcatggcctctgctccataagctctcagctcctgaaagtcactctttgaacagaacctaaaacttagtttccactgatgcataagtgactgagaagatgtacataaatgggccgcgcggtggctcacacctgtaatcccaacactttgggaggccgaggtgggtggattacgaggtcaggagatcgagaccatcctggctaacacggtgaaaccccgtctctactaaaaatacaaaaaaatagccgggcgtcgtggtgggcgcctgtagtcccagctactcgggaggctgaggcaggagaacggcgtgaacctgggaggcagagcttgcagtgagctgagatcgcgccactgcactccagcctgggcaaaagagtgagactccgtctcaaaaaaaaaaaaaaaaaaagatgtacataaatgtccctccaggaccccaaaattttcccagggcatcaaactccaggccaacggtcagctaaaacattgaaacatctggaatctataagccccggggctcactgagagtggacctgtgttctgtgtgtatgtgtggggggtgctcactgagaatggacctgtgtgtgtgtgtgtgtgtgtgtgtgtgtggcggggggcggggggcatccctgagggcaaaccacaaagtagcctaacccagccatgaaatgaactcctgggcaaaggaagtcaaccttcgtgaatctccacatacccaaggaaaggtggctctggccacatcactcccaagctgccactttctaagcgtcctgggctgccaggccagacacccaacagggccactccctttgctaacttcacacaacgctgagaccccacttcaggtagcgacaactttagggtggctgggtgctgcgttctgccaccctgtgccatccacaccagcccatctgctgcaccccaaggctaggcaccctgaagctcccaccacctacagtctcaacccagactccagggccaactggggagagaggctgggctgcttcctcccctttgccgtttcctggtagagctgcccctgcttcctccctgcccagcccactgtcacccagggcttggtacacacacccctctttctcccaggacctcgatctctggccaggggctgtccaaccaggccagtcccagggaaagccgacttcccctttggctagctcggcccaccgaagctcctcccctccctcactcagggaactatttcccagtttggaaaactgctccagacttgggaccaggaccagctgccggaaaagagccgcctgggaaggggtggaccgcccggggcttcacctttgaccccgggagaacacctgcagcgagccacccccacttcctcttcaagcacccctgccttcaactggatcgctcggcgctcacttaaacaggcaccccaaggcgccgggcctggccccctcccacatccccacggctccctcccacctcccgctggcggccttttagtccccgaggcccctcgctcgaatcccctccggtatcagcttgagcaccgagtgacctcacgctgatgactcagcaagtctccctccgggctctggcacgcgactgacggaacccgagccccagccaggggcagggtcttccccgcagcacccccatcgccgcccctcctcccgggctcgccgcggacccccgcgccggggagagctgacgcggccaccggatgaatcagcagctgcgggccgggccgccgggccctggcgcggacccccgggcgcctcgctcgaccccaccctttcctcccgccgtccagtgcccctccctccaggacgcccgggtctccgagtccgctccgcactcgcccggctccgcgggtccgccgccgcccgcggcccacctccagtacccgggcgccaggggcaggaggagctggctcctgaccgctggggaaatcgaggcacgggccgccagcagggtgcgcggcagacccgaaaccagcggcccccgccgccgggcccccaaccgcccgcctagctccgggaggagccctgcctgcgcgccccctcggcccccgccgcccccgccgcgccgcccccaccgcccgggcccgccgccgcagccgcactcaccacactgcgggcccggcgggccgaggccggggcggggcggggccgcgcgcgctccgaggccgcgcggggcagggaccggcgcgaggggtccgggcccggggctcggaggactcgccgcctgcgcgggccgggccgagcgcactgggaaggccgggccggaccaggctcgggatccgccgccgccgccgccgctccacagacgtcacatgatgtttggtcacgtgggctccattcatgaagcggcgacgcggccggccggcgcttaaaggggaaggcgcggcggcgggagggcaaactgcgcatgcgcaacccgcgcgccgtcgtccctggcaacactggctgctctagcgcctggcggggtctcacgggcgggcctgggcgcacggccaaagcgccaggtctccacccccagcccccggcgtcctgcagccggagcctgcctcgcctggctcctgcgcccgccgtccagggcccctgtccaagctcgcggacgccggcggcgttttccagctcgagtgctcagcctagggcaggctctgcgtgcgccccctcgagtgccggcctgggccctgccaggcagaggcgctcttgcgtcaggacggcgccgccggggccccgcgattccaactcgggggtcccggagcggcgcggggcggggacggcctggcagctcccagcagcgaggggcgatccccgcccgcgcagcagaccccgagctgcccaggcccttcctgcgccacgtgtacccagagctccgcccgggggagacttcgctgcttgttggagatgcccagcggtagggggcgaggactcgggaggaagataaacgggggatcccgtgtctggactttctcctccaccctcttcccttcgcagctgtgaatcctgggaggggaagggtggccgccccgccagcaggtgagcggggaggaaggggcggggacgggctgtggggtcctcctgggctccgtccatgaacaggccggccccaaagtcccgaagccgtgaggtgtaaggctcagaagcgtccctccgcctgtccctgccagaccccaggaactcctccgagccccacagcacgttgtcgccgtgtgcgctgtggggctgcgtgtggttcttacggtggtgtccttagtcgtcggggacctgctccccctgctctggacacagcccgagtctcacaggctctaggggcatgatatggtcctggcgtggcttccgaggcctcaaccttagtgtacaaaacagcacacggggccctgaggccaggagtgcagctccgtctcctgcctctcctccctgctcgcgtcctcatcctaccacaccacactgggctggcgaggggagggcgccctgagccgctgggcatcctgctccgcgggagggtgaagtcgtgcattgctgggcggtgagggctaggtccacacagcggggacctggcgggcccccgagtctcctcaggacccgccctccgtgccacacagcgggagctggagccacggtgccgtcaggagccaggggtgattggccctggggctggcagcccccaccccgcgggcagacgctcaccaggctgtccccactcactcccacaccccaactcctcctcacagggtcgagcccgctctcatttgcacctccgcgcgaatttggaacggatttatgaatcgtcctcactgcggtgctgtcttctcctgggaaggagcctcagtcctcccctccctgggcactgtcatagagatgggcaggacgggctggggaggacactcagggagctgcccaggctcctttgctgcccctcaccccagaatcttcttggggtgggtggggtcccaggcacctgcagagtagcatacggtggcttgtagaaagagtatcgagggaggggaggtgccacgtggaaacagcccaagccaaacccctaggacctgtctccctgtcctcctagagagctgaaggtgttccgtggtcagtgagggctggcactggctctgcacgaagatctcctcacctccccagcggctcctggccagctccccacggagagcccaggacacttgtccctggacacagtggtgcagccatgcttgggccaaaccatgaggccaccagaaccgcgaaaggctactgtactgagagggatactgcgagagaggcccacaggtttccaagcatccctctcactccgcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccccaggctgcagcttctgtgggactgagccccgcaggcacctccccggcatcctcccgccccaggctgcaccttctgtgggactgagccccgcaggcacttccccggcatcctcccgccccaggctgcagcttctgtgggactgaccttaagaccccatcggttcctcctgagagcagcagatctcagccagatgctgccgggagggaggtgctagcgtccacacccagacgggtccagtccagccctgctctccctggtctccaggcagggccctcccagggtggacattgcccatctctgcctggccaggggctgctgacccactggttccagagtctgagcctgtcctgcacaagtaccatggacaggggtcagccgggcactgaagaggcgtggcagaattgggcagggcaagggccccagctggcaagctggagtcagggcaattccaaccaagaaactgcggcaggccgggtgcagtgtctcaagcctataatcccagcactttgggaggcagtgggagaatcgcttgagcccgggagtttgagaccagcattggtaacatagagaccctatcgctacaagaaaaaaaaaaaaaaaaagctgggcatggtggtgcacacctgttgtcccagctattcaggaggctgacgtgggaggattgcttgtgcccaggggttgcaggctgcagtgagctgtgatcataccactgcactccagcctgggcgacagagaacctctctaaaaaaaaaggaaaatgaaaaataaatgggggcagaagctgagccaagcagaggcgggcagctcctcctccagggcccacctggcctgctggggactcactccaaaccgcttcatttttggagggggctttccaggactgagaggtgtcagagctgctggtgacaggagcagggaaagcaccatctggccagcccccaggggccccctgtagggttcctctgcctggcagcgtttcgacgcttcttggcaggatccttgggtccttggcccccggcaccatctccctccttgacctgctgaggcccacataaaacatgttgctacttggggtgggcccgtcctcacgctctgtggcttcctgggtgtccacctccccacagcctgcctcacctacctccccagacttctcacgcacgtcaggagcctcctgtggactctggctctacctgcctctggcctctgcttaatcaggaacccacagtgggaaagctcctagggcccgcctgctgaagcaaacgcctccttgcaaagcccgtctgcagccccccacacacctcctcacctccctgtgcttcctctggagcccaagaccagtctgcctcacttgaaacccgcgtcgcctgctggcttcccttgtgtccccggaccagaagcacctttggcagccccgcgcccctcgtcttgctctgcgtcagcacctgagaatgggcgctagcagggaaactggctttgaggggaatggtcggggcagctttggtcctgggacaggcgtgtggcctgtgggacaatctcttctgggggcacctctgcccaggtgggaggagttgccagggtctcccagcactgccaggcactttgctggggcagggggttattctattgctcacagccctgacacaagggcattccccacccgccctgatgcccacatccacccatacaggagggggccttcaggggagcctgcagggactcccggcccagcaccgtccatctgtgtcccccgcttagctcctgcactgccagatctcagccagacagcagggactcaccccacctaccgtcccctttgtgcctgggtgtggtgggtactcgttttatggggagtggccaggactcttgccagggggagagtggcggtggaggatgtacccatgccatctgccctgccgcagcgtttcctccctgttcccctgcatgtcttccctccctcgggggaaacgcaggattctgttccccaagcgccctctacacgccccatatataccaagcatggttctgcagtgagcctatggggtctctggaaatgagttcccgggataagttccagaaagttgctcagctctcctaacccctgcacaccctggagccccctgcataccctgactcctggcgcacctgggacccccctgcacaccctgacaccctgctgctacccagcccagctcccctcacacagtgtgcactgcctctggagggaagggggcctcatcttgctgtctccatactcagtaactatgtgttggttgaaggaaccagagcacccctggcccttgtaacccaaccctcagcagctcctccaatcctgtgggcctcctggaatgggtgattgtatgtgtccacttgactgggctacagggtgcctgagtgtttggtcaaacattattctgtttctggcaggggtggggaggggttgcatgagactaacatttgaatctgtagacttttgcattagattacattgacattttaatcagtaaggcagatgccctccaagatgtgggcgggccttgtctaatcagttgaaggcctccactattccacccacagtaaccaccctcccacacaggcagggcctccctcctcatgtggcagacagaagtcaggacactgggggctggaaaccaacttataaaactgaaagggccaggacagaactgatagcaccctcccagggaggtcaggagcaggaggtggtggccacagaagttcaccagcagcccaaggagccctttccccaaatgtccatgggatctgcgtgcttggcagccaagaggggctgtggcccttcacgctggacttgggatgcctggaccctctggcccttctcacacgggaaggagaggtttctccctgaatggagggcagggaggggccgggagggggcgtgggatcccacctctgctgagccttcacagagggggtccttgacctttgctctcaggaaggagcccgtgccagctgatactggagtaggagtgggtgaagaccctccgggctcccgagctctagaggaaggtggtcctgacatggtttgggagcagagaagaaaggaggttgaggttggggaatccacccctgttctgggctgggaagcacttgcagaccacagagatttccagtgggaagtgatgtggcccctccctggctatgtccctggctggcccctgcgctgatcagagccacagaaagtgggccactttggggaccccctagtccccctagtgacaagagaagagaaggtggtggcaggatggtggtcaggcaggacgtgtcaatccttgcccgctggggccaggctgcgggggagcagcttggtgtggccagaaggcgacagagcggtccctgcaggggagtccagcttcaccttgtccaggatggtcttcttgatggcggctggtgacacctgctcctggtcagccatggactgcagctccctagagaggcagggagaggttggctttggagcacaagcgtgcacccaggaagagggagtgaagcccacagctcccagtgccagtcagccctgggcgatgctgtcaccctcacctcagcacctttattcccctctgccagcgacacgcccccacacagctgctgggctccttctcacctcattcgaatcagctcagcatcaccaaatctccccgcagtgccccccagacctgagttctcgtggccccaccacgggatgtgggtttacacctgtctcccctgcaggctggaggtgaggccaggcccctcgtgttcccctcactgttacagggtggcactcgcagagtctgagggtgtctggactggagagtgggcagtgtggcgagaaagacgtcctcacccaccctgcagacctgaactggggacagcggctcccagcctggctctgcctttgaccagctgtgggatcccaggcaaacagcaaactctgtctttctcttgctctttgcttctttcaccttccatggaattttccttgtgcctggatgttgctgcgtgtcctactggtctaacttaatcccacagcgagggcaggaggaaggtgggcccccacagaagtttcctaatgtggctggccaccccgccaccccactggtgtggcccctggctcaaatgacactcctagctatgacaatggtgaacctatgtggggagcacagggcacagcatccgggtccctctatggatgttccctcctcgcaggaaacggaaggtggggaggggcactgcccacagtaacccagggaacctcggggccccctgtgtcctgcgcaacactgggctggagctcaatacgtatctgctgagtgcgtgaatgagcagatgtgtgtgagagaggcctctgccatgcaaggactggagaccagggaagcgggcagcgcgggggcccaccgtgtgcggatgcaggaggcctccacagcgttgatgagcagggagcggaagcccccactctccagcacatgcaaggcatggatggtggccccaccaggagagctgacgttgtccttgagctggcctgggtgctgttctgagtgcagcagcatcttggcagccccctgcagccagaagaaaggctgacggctgtgggcacgcacctgcctctgcggggcactgccccagccactgtagcacacactgacgccccacttggctcctcccagtgaagccccagggccccgcaaagagtggccccaccagagggtcaggaaacacactgaccaggagggcctgggccccgaggcggactgccaggcgccttggaagtcccatcttcacacccccatcagccagggcatccagggctgtgaatgcctgtggggagaaggcaccctgagcctctctcctgggcttctcctccttcccttctgggcaagctccagttcccacagccttggagccctccaccctggccctcccagggggagcagggacagatgtgcccggtggtcccgggaagtgcccgccgccgccagcttcccccgcagtccttacgtaggcggggccgctgccactgagccccgtgacggcatcaatcaggtcctcttccacctccgtgcagaagcccacgctgctcagcagctgctccatgagcctcccgtcctccacctgggcgtgcgtgcctgtggcatacacggtggccccctcccgcaccacgactggagtgttggtcatgcagcggatgaccctgggggctggccgaaacgctgacagcttctggaagagaaaccagcgtgtccgtctggccatggacgcagtgcctagatgcactcaccccaccaagcagtgcccgagctctcccagtgggccgggacgctgcaacccttttgcagatgaaaactgaagtactgagggcccgggctctagacagcccctctccacaccccactgggcctgcggtgctaccttctcaatggagctgatggtgacgccggccgcgcaggacaccacaatgtgtctgtcctcaatgtcggcgcctatttcatccaggatgaaggggatgatgtgtggcttcacagccaggaagagcacatcactgtgctgcaccgtctccttgttgtggggtgtcaacttcacccccatcttctgcaggggcaacaggtgggctcagcctggtcccgtggctgtctgtacccccaccaagccaagagccccacaggtagaatggcacagagaatgctggagttgggggtgggcagggctgggggctcagggctctgaccacccccttgatgacccttcccacccagaaatggaggaagaactctgtgtggaatatgtccctgctgcagacagaaaaggaccctccatccatgccaccaatctgcccccagcctgggactgccgtcctccagaccgggctctccacgtgggagtggtggtctcaagcagcccccaggtgtgttccttggctgccaggctgtggccccacctgccaggcccccagaggacccctcgaaactttaaccctgtgcagggaactccattccagaacaacaccctcctatcagctgtacacacgcccaccacccaggtcccaagagcaatcagcagggcgaggaggtggggtccatgagaccccagcccagggcccctgccctcactggggtgggggctacagcacacactcctgcctctcacacccagccccacagagactcagtctcctttctccctttcatctgcacctaccctgagagcagaaactgtggccaggtccatgtctggggagctagccattatcttgtgggcagccaagacgcctgaggggagaaacagttcctcttcagttctttattatttttttttttttgagacggagtctcgctgtgttgcccaggctggagtgcagtggcgcaatctcggctcactgcaagctccacctcccgggttcacgccatgctcctgcctcagcctcccgagtagctgggactacaggcgcccgccaccacacccggctaatttttggtatttttagtagagacggggtttcactgtgttagccaggatggtctcgatctcctgacctcgtgatccgcccgcctcggcctcccaaagtgctgggattacaggcgtgagccaccgcgcccggccggaaacagttcctcttcatggctagctttggcttccctccctccccattcccaggaagaagagtgagacagcacaggtaaagccccaaacacacagaagttgccagttcccgcaggactcaggccttgtgacccagcacccaccttcagcccccagccctgcagaagtggaaagaggccagtctctcccactgggcctcaccgtcccccacctgggggcctacctgctgctgtgaagcccttggccagggcaaaagccagctggccagcgccgatgaagcccacgctcatgctgtccggagacccctggcccaaagcccccacagatggcaccggctctgcgggacgagaccggcaggatcgagagcaagttaggggggcagtgccagcctggccgctcctcccgcagccgggtgcccacctcccctggtcccagctggtctaactttccactttgctgtccggcccgttaactgcttcggggcccccagtcagagcggcggtgcctggcctgctgcctagggtcccgcacccactggaggggtggaggttccgcagaagaaatgactgggaagggggaaaagtacggggagagggagggcccggcgcctaggggtcccccgtctgggttcccaccccgcccagaactgggctaccgtcgcgccccacccggcgaccgccgcccaccattcccggagcccgaccccaacccagctaccgtgcgcgggtcgtacccacccctcagcgctgcggccgccacgcggcacccgcacccaggccccgcccccgtcgcgccagcgaatccgggcgcggccgccaggcgctggccaatcagagcgcgcggcggcgccagagcggttgcatcatctgcgcgcccctcccacgccgaccgccggccctcgcctctctcgcgccccgggatcccccggcccccggatagacaccctctccggcacgcggtcccctgacccgcgctcctcctggtcgcgcttcccgggacctacacgtggggtccgaggacgcgggcggagggggcggcccgattggggcctgtgaggggccctccacgcagggctttgtcttgggccacccggacacggacgcgtccagctggcgtccctgggcgcgcggccggctctctctgggaatcagtcccttctactgtcatcgagtttggagaagcccggctgtacagcgttttctttcctttttttttttcccttgggggcagagttgaaaataatttgccaagtggaagcattttaaatatatcaccatttgggccgggcgcggtggctcacgcctgtaatcccagcactttgggaggccgaggcgggcggatcacctgaggtcaggagttcgagaccagcctgaccaacatggtgaaacccccgtctctactaaaaatacaaaaaattaaccgggcgtggtgacaggtgcctgtaattccagctactcgagaagctgaggcaggagaatcgcttgaaccctggaggtggaggttgcagtgagccgggattgcgccactgcactccagcctgggcaacaagagcgagactccatctgaaaaaaagagagagagaaagaaaggaagaaaagaagaaaagaaaagaaagaggcatgacagtgcggccacaggtgttcctctaactgggcacgcagcggtgctccactaagcaaacgaaggaagcccaccccatcatgcccccactcccacgcagcccggagcatcctccaatacccaaacctctcgcctgcctgggttttagggggagtgaagctccagtcacttccccctgaggacatgctcagagttcatctgattcgggcctgcatctggggctctggatagtcagggtccctgtcggtggccaagattaagggcgaagtcagaagggatcactggcagcccattcccctgccaaggggtgagaggagctgccttattttttctgtgctgtatcttagatgatgacaggctattctagcacatcatttcagaaggcctgggatgcttctgccacagcggcagggccacgcgttctggctatctgtctacctggtccccccaccgtgaacacgtaatgaccaccaccaacactgggaggctgctctgtggtggccatgggaagagcttgtccagatggacagctcaaacctggggcacggaggctagcatcgcctaggcgctttgagagccaagctccccaggctgttacaaaatcacttttccccaagtgataacagcaagtaacacttttacctaaaaacccaaaaacccaaaatggacagccctctgggccagggatacactgtcaaaaggactgactctgaaggaagtctcccagccctgggtcccctccccttcctttctgtccctcaggacctttgcgaaggtggcagaggaccaccggacagggaggaaattgggaagttggtgacaattaactcgtttcagaattctggccacatgaaaaaaaggagagaaggaggctgggtcctctccaagactggtgcccaggtctcccctgagtcaggaagcaggtgatccctatgccccctctgtatcgccctcagccagcggcaggccctgaacagctgactgccctcatctgggatctgccattgaccccaaaacacccaccccctctgagtaaaggatgtcggccggaccctgtttgttggctaacgtgagcgagacccctcctcagcggccagtgaggccccttcctcacattcttcatggcagcagcacaggcctggctgtggggaccgccgtctaaaaggagcaacagtgcgtctgtccatcgctgtgtccagggcctctcgagacccccagatgggcgtgggggaggaggtgagtgctgcgggcctctgggagggacgggcatgagccacaggcccgtcggagccaggctggcctgtcacccctgtgaggcagaagacgctgcctgccccttccccaggaggctgctcagaccctcaggagcccagcctgccctgactgtgatcccaggccacttccttcctcagccttcccccagagcacgctaggaggggccgccaggaggggcaagtgcccacagtcccctcagaagagactgctggtccagaggcagggtacgtataaatgtcagcatttatttcctgctcaaggacgtcaatggggcccagtcaatgggctgaggggctgttgtgccactgcccacccggcttggactcaggggtggccagtgggtcagctcctggctggaccaggctgggcttctgtgcaggagaagctggctggagcctggaggatgatggccccggcgtcaggagtttcggcaactggacccttgagcagaggcaagcagtacccagattctgtgtccagcggccgccctcagccgggctccctcccagtgccacagatgcccacagtgcacagatgcccgccgggcactgctgaagctgcttcgtcacagccaatggtgagtgtccaggtggggctccgtggctatggcggaaccaggtcctccccgtccactgtgcactcggtgccgccgggctctgcaggctcttccaggccacccgcgccacctccagcctgcggagactccggaggaagcctgcttccaaacactgtggctaccagcccagaggcttcccggacgtgggtgggagaggctggtccagatttctggctccttctctgtgagctggcacagctccccaggcagggctctcttcccagggttctgggagctgcctctctgaaccaggagtggttccggctccccacgcccctccctccccttgcctggcccagctactctcctgggttcgtctcctctggaagtcattcctctttcagcttgccttacccagcctgactgtggtctccagacactaatggaggtactgggtgcctcgcaaatgcttctagcctccatgtccccagctgcaaaatgggtcacaacagcagctgctttaaagttttcccttatgatgttccagtgaccagcactgagccccaggagcgctgggaaatggtgagagagagtgagttggggattggcctaggtgaggctctcccctgcgtctgctcagggcctctgccctactgtcctgcccttgtccctctgagcccagtctggaagtcggggagcgacctctcccgttgtacttcatctcccctgagcccgcggcttccctcctgctcgctacttgacactttggttcacctgagtttccctcgcagagcctggagctggtggccagagagcagaggtgggtgggctgccactgtgggctacaggctgggcacgaagcgaatcctctgggagtaggcgaggtcaacgacgtacaggagcaggttgacgtaggtgaagatggccaccaccagctggctgtcccagggacagctgccccgagcacagttggggggccgtttgggctcaccgtacttgggatcgaaacagaagactggccagatcacggcggcgctgaggtacaggagcacagccaggaaggtgtacaccaccaccagccagtcaaaggggcagcccaggccccctgtgtggcccatcacactcagggccaccacggccactgtggccaggaagcacaggctgtagacggccacgcaccactgggtggccacgtagcgcccgtagcggctgtcatggaccagcgccccgaagatgatgcaggccacgaaggcctggacgatcttgaggagccccgacaccgtggccatatagctgctcacctggccgggccgggcccgcgtcagggccacctccacagcgtaggccaggaagaggagcccggcgaagacactggctgccaggcggaagtccctggcagcacagccggcgggctcgggggaacactcccgccgggcaaagtacagcggatacaggaccgcagccgtcgcgcatagcagggtggccagcatggcgaaggcggcggtgaagttgccccaggagagccgcaggcagccgtggagccgtgtgaactcacaggccaccaccagcgcagagacggcgaagcagaagccccaggcggccatgcagaaggtgccctggacgcccgcaaagccaccccggtgggccaccaggctgaaggtagtgcagccaaaggccagctgcagcacgcgggctgtgcccacaggggatgtcacggcgcccaggtgcaggtacgcacccccagggggctccatggtgctgcccatctggccagccacgtttccagctcacacagtcccccaaggccctggggtccctgctgggccaaggcccctcagtcctctgcggtagtggcaggtgcctgcagcctgcagaggcagtgacgacggtgacattgcagcagggcagcctctctgctgtctatgtgaggcggctccccccagcgctataaatagacagccgtgatcagagccccggaatagcagcttgcgtgcctgtccccatcttagagagacatctgacccctggtcccctgtggagcccctgccgggaccattaacccattggctgctggcaccacccccacctccgcctcccgcgcacctgcatctgtcaatccggtcagttggtttcacgcttgtgggggagggggagggagaaggaggggagcaaagagcatgagggtccccacggggtaaccccagctccagcagcctccagggccagctgtgggggggaggggtgtaggaggcaggaggcggcagcctgggctcctggggctcgcgggggtcggggatggtttccccaacatttatctcaccccttctggatggccgcgtggttcagagcctgcatgggcttcaggatcctgctgtcattgcctggggttcacagggttctgctgcggccagaggagcagagcatggagaccgtggcctctgctccccgagccccgctccccaccctcattctgtctcgtccctaacctgcctggggcagagacatttgactgttagttactgttactgtttgcaggggccattctggggcttttcacttgtccttcacattaaacacctagaaaaacactcaactcttccctttttttttgagatggagcctcgctctgtcacccaggctggagtgcaatggcgcgatctcggctcccaggttcaagcaattatcctgcctcagcctcccaagtagctgagattacaggcgtgagccaccatgcctggctaatttttttgtatttttaatagagaccgggtttcaccatgttggccaggctggtcttgatctcttgacctcatgatccgcctgcctcggcctcccaaagtgctgggattataggcgtgagccactaggtccggcccctcttttttttcgagatagggtctagctttgtcgctcaggttggaatgcagtggtgagatcacagctcactgcagcctcgacctcccaggctcaagtgatcctcctgcctcagcctttttatttatttacttatttatttatttaaccacttgcactcacttccacctcttccatttttaagctaaaatatgaaatgtttttaaaaaggaaaaaaatgatatctttttttttttttgagacggagtcttgctgtgttgctcaggctggagtacagtggcgtgatctctgctcactgcaagctccgcctcccaggttcacgccattctcctgcctcaacctcccgagtacctgggactacaggcacctgccaccacgcccggctaatttttaggatttttagtagaaacggagttttaccatgttagccaggatggtctcgatatcctgacctcgtgatccacctgcctcggcctcccaaagtgctgggattacaggcatgagccactgtgcccggccggaaaaaatgatttcttactaatttttttttctttttttctttttttttttttgagacagagtctcgctctgttgcccaggttggagtgcaatggcgcaatctcggctcactgcaagctctgcctcccaggttcacgccattctcctgcctcagcctcttgagtagctgggactacaggtgcccgccaccacgcctggctaattttttgtatttttagtagacacggggtttcaccatgttagccaggatggtctcgatctcctgacctcgtgatccgcccgcctcagcctcccaaagtgctgggattacaggcgttagccacctcgcccagctttgttactaaaaagagaaagaaaaattgcctgtaattccatcacctggattcaaccactttgaacatcttctggtatatccttgtatgtatttcctggactttttagttagaaaaacttaaatccagccgggcgcggtggctcacacctgcaatccgagcactttgggaggggctgaggtggatggatcacgaggtcaggagatacagaccatcctggctaacatggtgaaaccccatctctactaaaaatacaaaaaaattagccaggcgtggtggcacgtgcctgtagtcccagctactcaggaggctgaggcagaagaatcgcttgaactcaggaggcagaggttgcagtgagccgaaatcacgccattgcactccagcctgggtgacagagctagattccgtctcaaaaaaaaaagggccggacgcagtggctcacacttgtaatcccaacactttgggaggccgaggaagacggatcacaaggtcaggagaaattgagaccgtcctggctaacacagtgaaaccccgtctctactaaaaatacaaaaacaaaattagctgggcatggtggcacgcacctgtagggcagctcccagctcctcgggaggctgaggtgggagaatggcgtgaacctgggaggcggagcttgcagtgagctgagatcgcaacagagcgagactcctcaaaaaaaaaaaagaaagaaaaagaaaaagaaatgcctactgaatctctgccctgggtttctgagacagaacttctaagaccctttcagacagaggcaggaggagtcttttattgtggtatttggtctttgaccccggttcctgacatagagctcctaaaacctttataatctcctaacccataggatcatctgacatggggctcccaatccccttgaatttcctgggtgacaggagcgtcttttgttctaatgaggcgactcctggtgggctcctggacagccttggggtggggggttggtggcagctactatgtgatcagaagggcagagcttctagccccacttgcagcctccaggagggacaggggctgaaggctgagctgatcaccagtgaccaatgatgtaatcagtcatgcctacgtaatgaagtctccataaaacccaaaaggacagggttgggaggtttccaggtggcggaatgcttggagggtcctggaagctccctggagaggcctccagatgaacagcattgcctctatctgctgttcatctgggtcctttgtcacacatggggaaacataaataaagtgttggcggagctcggtggctgacgcctgtcatcccagcgctttgggaggctgaggcaggcagatcacttgagctcaggagttccagaccagcctggccaacatagtgagaccccatctctacaaaaaatacgaaaattggctgggcgcagtaggtcacgcctgtcatctcagcactttgggaggccgaggcaggtagatcatttaaggtcaggggtttgagaccagcctggccaacatggtaaaactctgtctatatttaaaaaaaaaaaaacaattggccgggcgcggtggctcacacctgtaatcccagcactttgggaggccaaggtgggcggatcacgaggtcaggagatcgagaccatcctggctaacacagtgaaaccccatctctactaaaaatacaaaaaattatccaggcgtggtgatgggcgcctgtagtcccagctactcaggaggctgaggcaggagaatggcgtgaacccgggaggcagagcttgcagtgagccaagatagtgccactgcactccagcctgggcaacagagcaagactctgtctcaaaaaaaaaaaaaattggctaagtgtagtggcacatgcctgtaatctcagttactggggaggctgaggtaggagaatcgcttgaacccaggagaccgaggttgccgtgagctgagattgcaccactgcactccagcctgggcaacggagtgagactccatctcaaaaaaaaaaaaaaaatgagttgggcgtggtggtgcacatccgtaatcccagctacttgggaggttgaggtgggaggactgcttaatcccaggaggttgagggtgcagtgaactgtgattatgccgtcacactccagcccgggcaacacaatgaaaccccatctccaaaagtaaatcaataaataataaaatgaggaaagtgcttccctgagttctgtgagccactccagcaaagtcacaaaactggaggaggggccatgggaacctcggttggccagagggcgggtgacacctgctacatttggtcatctgtcctcaggttccacacccaagtattcaacaaacctcagactgaaaatacaaaaaatactggcccggcgcggtgggtcacgcctgtaatcccagcacgttgagaggctgaggcaggcagatcacctgaggtcaggagtttgagaccagccaggccaacatggtgaaaccccatttctactaaaaatacaaaaattagccgggcgtggtggtgggtgcctgtagtcccagctacttgggaggctgaggcaggagaatcgcttgaacccggaaggcagaggttgcagtcagccgagatcgtgccactgcactgtagcctggcgacagagcaagactcagtctcgaaaagaagaaaaggccgggcgcggtggctcatgcctgtaatcccagcactttgggaggctgaggcgggcggatcacaaggtcaggagatcgagaccatcctggccaacgtggtgaaaccccgtctctactaaaaatacaaaaaattagccaggtgtggcagtgggcgctggtagtcccagctactcgggaggctgagacaggagaatggcgtgaacccgggaggcagagcttgcagtgagccgagatcgcgccactgcactccagcctgggcaacagagcaagactccgtctcaaaagaaaatacaaaaaataaataaataaaacaataaataaggccaggcgcagtggctcatgcctgtacatccagcactgttgggaggcggaggtgggtggatcacctgaagtcaggagtttgagaccagcctgaccaaccaacatggtgaaatcccgtctctactaaaaataacagaaattagccaggcctggtggtatgtgactgtaatcccagctactccagaggctgaggcaggagacttgcttgaacctgggaggcggagattgcagtgagccaagatcatgccactatacttcagcctgggtgacagagggagactccatctcaaaataatagtaataataatacaaataatacaaatttaaaaagcaatactatgtaacaactgtttacatagaatttacataccaggtgttataagtaatcaagaggtgatttaagtccagaggagggggttatatgcaaataacatgccattttgtatcagggactctggccttgtggattctggtgttttggaggtactggatcccatcccccaaggatacaaagggacagctgtacttgggactggcatctgaagtggaggacactcttgtgggactgagaccttagcctgcaggatcgggtactgtctccagggagaaagcgtcacaatggaacagggttggaggacgcccagcgggtgtccgcggagactggatggaaccgggttggaggacgcccagcgggtgtccgcggagactggatggaacagggttggaggacacccagtgggtgcctgcggagactcgctggagcagggttggaggatgcctagtaggtgtccactggagacttgcttggtgtttggggaaaatccccacacacattttggtgaccagagatgaagtattccatgttggatgttgactgttgagtgtgtgagagcagggaaaacactgtttttttttcctgtctcagacaccagcccagccctggagtcagccgtgtctcccaggaacctggttccttgtgttgggggaatggcatcagagaccaagacatgggggccaggcacgcttgttgctgctgtggtatacattcacaaacgttaacaaatatttttatttttacttatttatttattgaagatggggtctcgctctgttgcccaggctggagtgcagtggcatgatctcagctcactgcaatctccgcctcctgggttcaagagattctcttgcctcagcctcctgggtagctggaattacaggcacgcagcaccacacccagctaatttttctatttgtagtagagacagagtttcaccatgttggtcaggctggtttcaatctcctgacctcgtgattcacctgcctcggcctcccaaagtgctgggattacaggcgtgagccaccacgcccagctggctttctttttttaagtacagagtttaaatttgtaatgttgtcacacagtggaagttccctgctttcagtccctgaatagcaaaggctatgccttggccatcgctgctggaagagacacggctcagtgttggatgaatgtcctgactgttttcgccccagagaatgaaaggcgccaaccgtcctgggaaaggtgagaagtcagcgtggacaagctggggtgaccatcactgcagagctacaggccagcgtcctcttcgtgtcctagggctcgttttgttcctggtcctgcaggacagcctggggtcaccgtcactgcggagctacaggccagcgtcctcttcgtgtcctagggctcgttttgtccctggtcctgcaggacagcctggggtcaccgtcactgcggagctacaggccagcgtcctcttcgtgtcctagggctcgttttgtccctggtcctgcaggacagcatggcagcgattgaccgattgaccattaggtgagctgcgcctctttctctttcggcacaaatgtgggaagaaagggtttatttgtcggtgaaatccctttgggcccaacccacaagtgtcctgttcagtgagcctggtccccccagacacacaccaccatccgccctcaggtccctttcagccacctcagaggagcaaacatcacgcctgccagactgcagtgctcaagccagagttggccaagagccagcacctcgcatgtggctcccccagctcccacagcacggcaggggtcccagcaaagtctccccagacagggtgacagccaggcctctttcgggctccccagccccctctccctcccgagctctgtccttgtggggagtcctgtccaaggccctgcctggaggtctggctctggaggccccgagaaggaggccaccagactcccccggaccccttctctcacctccagccctcggtctccacatctctgaccttgtcgtctccattggctgctgggactccatggattccctccagagaccacataggagtgctccacagggggatcgtggacaggccacttggctctgcctggggtggcagacacctgcccacgggcaccagtcctgtctgggtattctcaggcccagggcagccctgactcattggcacagagagtcagaccccaggacatgtccccaaggcacagggtcctacggtcctggccactctgggaatggagccgtggccgcagggcaggtgtgaagctcaggctgacgtggccccgtgtcctctgacccttatggtcacattgcctctctgggcctgtttctttgtaaactggagtatttattttattttattttattttttgagtcagaatcttgctctgtcactcaggctggagtgcaatggtatgatctcagctcactgcaacctctgcctcctgggttcaagcaattctcatgcctcagcctcccgagtagctgggactacaggcacccgccaccacacccggctaattttttggtattttcagtagagacggggtttcaccgtgttagccaggatggtctcgatctcctgacctcgtgatccacccgcctcggcctcccaaggtgctgggattacaggcatgagccattgcgcccggccttttttttttttttttggtatttttagtagagatggggtttcaccatgttgcccaggctggtctcaacctcctggcctcaagcaatccacccacctcggcctcccaaagtgctgagattacaggcgtgagccaccgcgcccggcctgtaaactggcgtttataatgaaacccacctcgtagggctacatacaattggcatggaatgctttgctcagaaagctccacccacaaccatgcccaaggctggcattggtgtgaccttggtattatcaaaactacagagattcatgggtacgtttgtgtgtgtgttttgagacagagtcttgctctgttgcccaggctggagtgcagtggcacaatctcggctcactgcaacctccaccttccaagttcaagcagttctcctgccgcagcctcccaagtagctgggattacaggtgtgtaccaccacaccctgctaattcttgtagttttagtagagacaggatttcaccatgttggccaggctggtcttgaacttctgacatcaagtgatccaccagtctcagcctcccaaagtgctgggattacaggtgtgagacaccgcacctggtctgttttttttttttttttttgagacagggtcttgctgtcactcaggctggagtgcactggcgcgatcactgctccctgcagctgtgacttcccaggcttaagtgatcctcatacctcggcctcctgagtagctgggaccagaggtgtacatcaccacacccagctaatgttttaattttttttttagagacggggtctccctttgttgcccaggctggtctcaacctcctgggccaaagcgatcatctcacgctggcctcccaaagtgctggggtgacaggctagagcttcatgtttttgccccaggaatcccacatctggggtttagtccacagacatacttgccctcatgcaacgtgatgaccacacgacaaggctatgcacgtgcaccctttgcacctgcgtgtgccgcagagccctccgcaggccctggactgtcacacctgcggcagctcactgcgcgccccgaaatacagtgtcaagaggaggagacaccagtgtgtagtgtgtagccatctgtgtaaaagaaaaaaatgcatgtatgtcaacgtgtgcacctgtttaccggaattttcacgaaatgatctctgggaatatccacaaggtaacactgtttgcccttggaagcagagccagggaacctgagctgtgggggaaatgggcattcgccctcatatcttctgcatcttttgaattttgaaccatgtgcaggaatgacctagtagaaagaaataaaatgcaaatgtttaaggaattgtcagctgggtaggaagtgttctggattgataaagagttttgaaactagggagtgggcgtggtggctcacatctgtaattccagcactttgggaggctgaggcgggtggatcacctgaggtcaagagtttgagaccagcctggccaacatggcgaaaccccatctctactaaaaatacaaaaattagctgagcgtggtggcacatgcctgtgattccagctagtcaggaggctgaggcaggagaatcgcttgagcccaggaggcagaggttgcagtgagccgagattgtgccactgcactccagcctgggagacacagcgagactccgtctcaaaaaaaaaaaaatttattttttatttatttatttttttgagacggagtctcgctctgttgcccagactggagtgtagtggtgcaatgcaatctcggctcactgcaacctctgcctcccgggttcaagccattctcctgcctcagcctcccgggtagctaggattacaggtgcatgccaccacacccagctaatgttttatatttttggtagagacagagtttcaccatgttggccaggctgatctcaaacccctgaccttgtgatctgcctgccttggcctcccagagtgctgggattacaggtgtgagccaccacgcctggcaagagttttgaaaccagaaacgggggtcacacggcactctgagtgcgacagatgccgagtcgctcacttggaaatggctcatcctgttatgcgaatttcttcccaaaaaaaataataaaatgaaaaggggccacgtgcagtggctcatgcctgtgatctcaacacactgggaagctgagcagggaggattgctggagcccaggagttcaagaccagtctgggcaacaaagggatattccatctctacaaaaaattaaaacagtagccgggtgtggtggcgcgtgcctgtaatcccaactattcaggaggccaaagtggggaaattgcttgagccccggagttcaaggctgcagtgagctgtgattgtgccactgcactccagtctgggcaacacgatgagatcctgtctctaaataaatgaataagtaaaaagaaacgcagctggtgccatccgccctgggaagtgggtatctgcagaagggttgaagggaagcagggcccctccagaagaccctgctctgagtctgtgcatccaagaaggggtcagagttggagagtccccacggcccctccctttgtctccctgctgctgtggggctggggaggggaggtgggggagggagaggaggggagagagggagggagaggagggaggggagggagaggaggaggggagggagaggaggaggggagggagaggaggaggggagggagaggaggaggggagggagaggaggaagggagggagaggagggaggggagggagaggaggaggggaagtgtgaagcaaataaacacgcgggcagggtgaggttcttttttgtctctttaaaatcatttttaaaaagttacaaaacaatatcattcatcatatattcttattttcctttttttaaaaaattaaagtaataaaaaagtcactttataaaataatataaaagggcttgatgggtggggccggtgggtgctgtctgagctggtggactgaggaatccagtgcttctcttctggctaccccctcgttgtcaggaaggacccccaggccacagatggggatgacagcaggtcccttgtctctggctgggctgtgggagaggggcagggaaagccggggcaggagggcagtgggcagacccagacaggggggacggctggggccctgtcccgaagagacgggagggcctgctggtggggggtgaggtggcactggggcagcgggtgtctgggcccctcagtgccggctcctcctccagacagtctgcctagcttccgttgctcagcatccccagcagctcactgggctccagtccctgcggctgggccaccgtctgcatgtcgaagcccatgtgcatgaggaactgggccacgttcatctcttgccccgtgaactggtctcggacggtggggcatgaggggttgcagtggggccaggggcagctgtccaccaggtggacggggcagcccttgaggggggtcttgctggccttgtggctgtcatggaggctcctgtcccagcagtgcagtgctcggggcagcgacgtccccttcacctggacatccgtccagtggctgcagaggaaaaccgggggagggggtcacatgtgcggagtggcatcaacactgaggcagctgtttttttttttgagaccagccatggcaggatctcggctcactgcagcctccgcctcccgggttcaagcgattctcctgcctcagcctcccgagtagctgggattacaggcgtgtgccaccgagactggctaattttttgtattttcagtagagatggggtttcactatgttggccaagctggtctcgaactgacgtcaggtgatctgcccccattggcctcccaaagtgctgagataacaggcgtgagccaccgtatctagcctgggtttttttgttttgttttgttttttgagacaaggtctccctctgcctgtcaggctagaatgcagtggtgtgatcactgctcactgcagcctcaacctcctgagttcaagtgatcctcccacctcagcctcctgagtagctgggattacaggtgtgagccactgctcagcctgagtctttttttttttttcttttttttttgagatggagtttcactcttgttgcccccaggatggagtgcaatgttgcaatctcgactcaccataacctctgtctcccaggttcaagcgattctcctgcctcagcctccggagtagctggattacaggcacccgccaccacgcccagctaattgtatttttactagagacagggtttcactatattggccaggctggtgtcgaactcctgacctcaggtgatccacctgcctcaacctcccaaagtgctgggattacaggcgtgagccaccgcacccagcctgagtcttaattcttgccatacagctgttggtacaagtggctctggcacccctataaggaaatcccacccctagaagcgccaagaagaggcccatgggaggccaagtgcggttggggagcatgtggacttttgaagttgatgtcatggacgcaagctgcccggagcagggacactgacctccggatgatgatctcatgggagaggcaggcgggggcaaagctggccctgttggagaggagacagtggcttgtgagctccttaccccctcagccccttttccacccccactcccctagagctgtcccccgcctggccatcaccccttcctgttgctatggctgccagctgttcctctggcccgggcctccccctagttggccagctcccggctgacccttatcgctttgtgcctcaaatccctgctcagagtccacctcttccaggcaggccctcccaggtgatggcaagaggctgccctagacaggcaaatattctgctactatctagaactctattttcattttattttgagtcggggtctggctctatcgccccagctggagtgtagtggtacaatcgaagcttgcttgcctcccacaggcaaggttagctcactgtaaccttgaactcctgggctcaagggatcctcctgcctcagcctcctgagtagctgggattacaggtgatgccaccatgcctggataatttctgtatgtgcagtagagacacggtttcaccatgttgccctggctggtcttagactcctggcctccagcaatcctgctgcctcggcctcccaaaggggtgggattataggcgtgagccagtgtgccaggcccaagaccgatctcgatctctctctctctctctctctctctctcctctctctctttctctctctctctatatatgtattttttgagacagagtcttactccgtcacccaggctggagtgcagtggcacaatctcagctcactgcaacctccacctcccagttcaagtgattctcctgcctcagcctcttgagtagctgggattacaggcgcctgccactacaccggactaattttttgcatattttgtggagatagggttttgccatgttggccaggctggtctcgcactcctgacctcaggtgatccacctgcatgggcctcccaaagtgctgggattataggtgtgagtcactgcgcccggcctacaagacctctatttttttttgttctggtttttcttcttttgttttctcaggacctctatttttaaataaggagggagctacccggcgtggggctcccggggcccacacactcacggcacgtccttgagtgtgtggcgcagctcgcggccgaggttctggatgtacagccgcaggccctcctgcaccggctgccccgtcaggtgcacgttgtccaccgtcagctgtgcctcgtcaaacagccactgcaccacgaacacagggcctgcgggcggcggggctcagttcggcctcccctgacccccgctgctgcccccaccccaggctcacagctcagcacccccaggcccctgcagtgcccccaccccaggctcagagctcagcacccccaggcccctgcagtgccccccaccccaggctcagagctcagcacccccaggcccctgcagtgccccccaccccaggctcagagttcagcacccccaggcccctgcagtgtcccccaccccaggctcagagctcagcacccccaggcccctgcagtgccccccatcccaggctcagagctcagcaccccccaggcccctgcagtgccccctatcccaggctcagagctcagcacccccaggtccccgctgctgcccccgaccccaggcagagctcagcaccctcccaggccccctgcagtgctgctgaggctcacaggccagctagccttggcccaactctccccaggggtgtcagtcataggcccccacagaatgtggcttccttctttcaaaccagcctttttataatccacagcttcataactaaatcaataactaaatcaacaactaaatcaataaactgcctttccttgaagacgggctctgtttaacccctccatgaccttggcctggttctcagcgactccactttcacctaaatatggtgatgatgcccttgcatataacctcaccattcctcagagcgtggggctggggaggaactagcccaggaccctgcagcagggaggggcagcatggggatgagctccaaagcacactagccaccggtataggcagggtgaccacctgtcccactttgcctgggactgaggggtgtcagtgctgagggcaggcaagtcccaggcatgccgcagcgactaggccccctggcacacagccggcctcctccctggtacacagccggcctcctccctggtacacagccggcctcctccctggtacacagccggactcctccctggaccagggccgtggtctccaagcccagcccagaagactggagtccacgctggattttcagaagcaaggaagtgtggccacccctgctgccctgtgtgctccgctctgccgcccactcacagcgcagggtcgggtagaccttgtagccaaagaagcagttccactcctcgccctcctggaactggcgtcggcagcgctccgggaccaccccgttccagtacctggagccacagccacaggttaggctgccgtgggtctcgtcccccggggctccccacccacagatgccactccacccaggcccttctggggcaaagctgcagcacgaggacgggccctccccgctgcggcacctgatgccacggcggatggcctccgtgggcgcgcacgtgatcgtgtcgacgcagtctgtgtggcgatactgcttgttgtccaggaaccagccggagtcagccaggcctcgcacctggatggctgggtagcccagcttctccagctgctcagccacacggtccacattcaggagcaccccggtgccccccgcgctgcaaggagggccagacgtgaggccaggtggctgggaagaggcactcacctcccccgagtctgctcagcgtcagcccgtgccccgaggggggcaggagtcctgatgcgttctgaactgcggatgcattctgcattctctgttcacgtgcaagacccatggccgtcccctccagagcaggccagggctcaggctggcaggccacatttccctgacacagccaggctctccccttcctcctccccttcctctctctgtctctttacctcaggttccttatctgaaaatgaagataaactatgtggcctcaggccccatcatctattccccatttgtctcctggtctcctgtatgcctgctgggatacaggaacccacaggggtgatcctcatctaccgggccctggagaaggagcattagtccatggccaacccctaaccaacgacttaggtccctgcagcccaaaccttcccctatatccaacaaccatggcgtccagaagcatcctctggacagtgtctggttacccagcactctgaagccaggcctcagagacgtctccaatgatgcgggttctcccagctccagcctctcaccctcctagccacctgccaagatctgcacaggctccactccatcctcgcctctcatacaaccccaccccacaccccttccatgcaccctgcacaccgtcctcacccctcacctccagccctgccccgccctgcccacctgctcccggccagcagcagcaccttggccccgctcagccctctgcccagaagctcccgcaccacctcctggatgatgagggcgcccatgaaggcgtactcgtctgcaagagggagggggtggcctcaggtaggggcctggacagagagaaccacctcctaccccagaatggctggcagagaagttcttgccccactgggggactgggaggaatcttctgagaaggggtcaggggcttgggtggactggaggaaggcgggtgcaccaggccatgctggggcctcctccccagggaatattcagaaataaggacctcctacagttgtggacaagcaggcagtgggagcatggggcaggcaccctgggacatactgtcaagggctttgaaagcacgacaaggctgagagtcagcttttccccagaacccctgccgtcccgcctcatccctgccctgccgtcctgcctcctccctgccctgccatccggccccgtccctgccctgccatgccctgggaaggccgagactcactcttctcagacttggatgaagccccgctccaaacatcactggagcagtaggggatgaagctgcaacacagaacagagtgagcctgtcacagcgcctgccgcccggcagcctccagaaaggacccccagaacaggaccctcagaaaagaccatcccaggacaggattcccctggaaggaccatcccaggatagaacttcccctcaagaaagacctccagcgtaatactcctcaggaagaaccaacccaggacaggaccctttccaggaaagaccaactcaggacaggaccccccaggaaagaaggaccatcccaggacaggatccccctggaaggaccatcccaggagaggaccctgccaggaaggaccatctcaggatagacccctccccaccaggaaggaccatcccaggacaggacctcctccccaccacgaaagaaacacctccagaacccctctaggacaggacctccccaaaagaaccatccagaacaggacccccaggaaagaccatttcagaatatgacttcccaaggaaggaccccccgggaagaaccaccctccaggcaggactcccaggcaagaccctgtgcccccttacaccatgtttgcgttccaccagtaggggttctcctccggctgtgaggacaggatccctgtgcctggggacacagaggcggtgggtctttctagcgggaggaggctgtgtagggtcgggtctgggaaccctggtgaggtgttggggctcctacttggccccaggaagggaggtgtgctggtgttgctagcccgaaccaaggttgccgggaaagtggaggacagttgggtttagttacccccgggaagccaccatggccacggtgcccggctaggctggacaccaggtctgaccttgacttcaaccccttgccctgctttgaccctggggagggccagagccgctgggtaagcgcctgaatgctaatgtggaatgggccccaaaaggcaagagtgaagggcgccccttgctcttagtaaacccgggcgccaggctgggcatgatgtgcggggtgggggcctggctggggctccaggaggcgggcgcggcttcctcccgggcctcacgtcgagacgccttccccagggcccgccgctgacctgtgcgagtgcgcggccagtcccgggagctcatgaggcgccgcatggtgtcgtatctggagtcgcagttctcgcggttgaagcagtaccagccgcctgcggacacgaccgccgctcaggcccgcgcgcacagacccccggcctccccccgcctcagccctggacgcaccttccaggaagaggagccaccgccggctgcccctggactccttcaggtagtagctgcgggggaggacgcaccgcggggggtcggccagggctgccgacccgccgcgccccgcgcgcccagctccggcggagggaacgcgccacctgttccggccgcgcgcgacggtcgcacgggggcgccctcggccaggcccacggggagctcagggacggcggcggtcccgggaggtggcgctcgcggggcggggaacgggccgcgcggggctgtggtccgtggaaaatccccacgttccgcccggcgcgggtcccgctgtcacctcggcgcgggcggcggtcctcccggggcgcgcggcggcgcttgaagcgtgaaacgcgtccgcactgaaggagcgcgcttggcgggggaacgggacgccgcggggagcgcgggaggcgcgggcggcaccgacccggcgggggagccttcctgccgagccccgaccccacgcccaagtctcccgctgtccccggctgtcctcggcctgttgagcgcgtgggcggccccgccgctccccgacccccgacctcacgtcttttatctacttcggggctgcaaggaggtgggcagcgggcctctccccgccccccggtgtcgccggttcccgctggagccaggcgcgctctcgggctgccatctccccgccccgggaccgaaggacgccagcagagcggctgggcccagaggccgaggggtcagtgcccgagctggccggggaccagcccttccagcgccgctccgctccccacgcggagagtcaccgaaccgggcactcctcggggccaggaccgcggggcgcccgacggaagccctttctccccggggagagaacggccgcggcccgcagggaaggtccagccggagaccgggcgcgtcgggcggggcggggaggtgcagggcgcgggccttacccggcggggctgccgtcgttgcaggtcaccgaggtgttgagtaggaggtgcaggcgcaggtcctcgttgagctgctgcgcggagcaggggtacagggactgcgccaggctcttgacttgcgccatgaagctgtccatgttaccctccacggccgtgaagtccagcgggaagctctccacgggctgtccggccgccggcgccgcctcggtccgcgggggaggaggcggctgctgaccccggcgccgccaggtcttcctgccctcgctgcccccggcgcagtgcagcaggctcagcagcagcagcacgcgcacccctcggcccatggccgcgtccacctgcggggagcgggcggccttgaggcggcggcggcggcggcgggggatgccgggccgggggtgccgggccgggggtgtcgggggcactggccgctcctgctccctcgcccccgctcccgcccgccgggcctggcggagaaggcgcgcgcggctcggcgtcgaggcgctcggggccgggtgccgtcggcctccgcagctggggctccgcgcccggccgtccgagggcagcgcagggtctgggtgcgctggctgcggcccgcgccaatgagcggcgggggccgaggctgggcttatttgcgggggccgcggcggcccgggtgcccgcgcgttagatgtgccgccgccgccgcccgggctcggcggaggggggagggggccgcgctcgctcttttcttggcggaggcatcgccttttcttcccaaaccgcaagcctgacggaggggcctggactaccccgccgcggccgccggaggcgctcccggcccggctccgtgggggggcagcgcggccgggcggccccggcggctccattcaccgcggccagcccggcgccgccgcccccccccgcggggcagctggaaggggcggcggcgacggggaggggcgaggcttttccgcgcctgccggggtggggggcggggaactccgcccgcggcgcagctggccgagcccgacgggctgggggcgcggggcaggcgcgctcacctggagccgccagtgtccctctcatcccccagtgcccaggcccagagcaggccgtgggggattcggaccccggcccgcatcgccccacctcgcgcagccctggggccccgctctcaccgcggccagcgcgggcggcccagtggccccgtcctctcagcgcccctggccctgcgccgtcccgctggtgcgcccggctcggctgcgctccccctctggcgctggcgcggagccgccagggacttttatccagcagggccccccgggatcaaagcggcggcggacacagggcttccagccgagggcccggcagcagtggcgccggggcctcctggagaagcggacaggtggggcgcgaggtcctggctccctcggagacctgcgggagggaccgcgcgccccagcaaggcgccgcgggggagtcgctcagttccggggcgctcctgctggcgctggggtcagagaagcagctacgacttaaggagatcgcggggccagaggtgaggtcctggatctccgcccgccccagcctggctgctggccccatgccgaggaccccccaagaacctgccccagccgccactgggggaggaggccaagggtccagtggctgcccgctaggcctctgcttgcggcccttcatgccacgaagggcacctgccccatgcttcaccttggagagcacccctgtccactcccgaggctctgggcagtggggttagaacaaggttcctgtgggaaatcagtactggagcagggtggacaggaggggttcaggaggtttcctgctggggtgagcgcgggtgggatggacaaaagaaaggaaaggacatacgcagggccagcggggccgggcagactttctccttcaccctccggtctgaagcctgctgggcgccatgacacccattttaaaaataggaaacaggtcttacgtttcaggacaaccaggtcttacatttcaggacaacgatctagacacaagcagagcttccagagcccctcctaattcaggacagtggggagcctacggcaccacgtggggcaggagagcagaggcgcagggcggtgcctgcagccaggatgcccccgagccgccggccggggccatgtggacgtcctccttgccagccccgggctgagtgaggagcttagggagaaagtcccagcgccgcctgcacccgcagacagccgagttacctgggctcttgtgaaacagagagaccaaacgctgggagctgttgccccgcgcattcgatgggtgtaaggcaccccagtgtaaaccacaaggcctaagatcaggctggggtgccctggaggtcagcctaacctggggacattctcagagggaggcaggctgtcacaaactcaggtccctctccccacagggcaggttgcagcattttcctgacgaggggaactgaggttcagggacactaacagaagagctgaggctcacccttagctctctgctcactcagaaatcccccctgctgtccctccgccgtcgggtcagtttaaaagccaagtgtggggctggccaagggcagtagcttcagacgcaggtcccatcctgaggcgttctcccacccacaccccggcggggaaggctgacccagggcagatttcagcgtccagcaggaacctgtccggaggaggcctctcccgccgggcacctgttattccaagtccggagcgtgatggcatcttccagctggctgcacagggttgatcttcacaccgccctggctctgagccatctcctggtgcagtatggacatcccagggaaggcctgtgacctttccttatgcctgtgcttcctctcatttatttatttatttatctttttgagacagagtcttgctctgtcacccaggctagagagcatgacgtgatctcggctcactgcaacctctgcctttcgggttccagcaattctcctgcctcagtttcccgagtagctgggactacaggcgtgtcccatcacgcctgcctaacttttttgtatttttagtagagacggggtttcaccgtgttagccaggatggtctcagtctcctgacctcgtgatccgcccaccttggcctcccgaagtgctgcgattacaggtgtgagccacggtgccccgccgcttcctctcctttaaagcggggtgataacagtgcctctgtcagagggctgttgtgggattataagagcccacttgtgaaattgcgcggtaggggtggcagtcatgatcaccgatgaaaattccaggacgggagaagaccatgtgcgttacagtttctgacgtctcctgtaatgcgatggagcctgcatgttgaaccgaaatgagttcacattttggtttattcaacactggtagcagacgccagaagaggctcaaacccaagacttccccagaacctctgcccttcctccacctccccccattcccctctcctccgaagccccttgccgtgaccggatgactgacaaggctgcagtcctacggccggggacggggctcccgaggctcagcagctgctcacacccatgtcctcctcttgactcacaccgactggctctgtcctcacacttccccagcccctgggacagctttatcctctgcacctgggactccccacccggagttttgagcacccagagcctggcagcagctcccgtggcgggtcctatgggccagcaggtgctgggcctttgcttccaggccacctgcatcaagatgggaccaacctggccctgacaggtataagaaagggggacccaggtccatcagtaatgggtcagatgctacctcatgcccactaagatgaccacgatcaaaacacagaaactaacaagcgtgggtgcagccgcggtgacacagaagccccagagcatcgctgtggggatggacagtgcagtggccacgtccctcaccatggaaaacggtttggtggctcctcagtatgttacacaaaacacgtgacccagcaggcccactcccagggatacacccagagaattgaagacaagtgttcaaacaaaaactggctcatgaatgttcacagcaggactagtcacagtagccaaaaggcggaaaacagccccaaagtccatcagcagatgagtgggtaaacacaatggaacacagccatacaacggaatatattctagccgtaaaacaaacgaagttctgacatatgctgcactgtgggtgaatcttgagaatatcagccaagtgacatgaactggacactgaagggcacatgcggtatgagtccattcatttcgagtgtccagaagaggcaacttcatagagatagaaagtccgctggtggtttccaggagatggagagaaacagggagtgattactaatgggtacaggatttctttttttcttttgtttttttgtaagacagaatcttgctctgtcacccaggctggaatgcagtgatgtgatctcggctcgctgcaacttccgactctaaggctccaacaattctcctacatagctgggattacaggtgtgcaccaccatgcccagctaatttttgtatttttagtagacatggggtttcaccatgttgatcagctggtctctgacctcaggtgatccacccacctcggcctcccaaagtgctgggattataggcgtgagccactgtgcccagctggtacggggtttctttttggggtgattaaaatgttctaaaatggattgtggtaatggttgcacaattttctgaatgtactctgtcatgtgattagatttttttttttttttttttgagatggagttttactcttgttgcccagactggagtgcaatggctcgatctcagctcactgcaacctctccctcccgggttcaagcgattctcctgcctcagactcctgagtaactggaattacagacatgcgccaccaggctcagctaatttttttttttttttgtattaagtagagacggggtttcaccatgttaggctgatctcgaactcctgacctcaggtgatccacctgccttggcctcccaaagtgctgggattacaggcatgagccatggcacccaccctgatattttaaagtagttagttctgactgggcacggtggctcacgcctgtaatcccagcactttgggaagtcctggaagaaggattgcttgagcccaggggttcgagaccagcctgggcagcacagcaagatcccgcttccatctaaaagaatcagtgggtaagaccaacaacgatcaggctgggcacagggcaccaggtggcggggatgaggcctgaggccccgtgagcggagtggccagcttggggtggagtgggccggctcctctctagaaaccttcctggcaggtagggtgtttcagaaccctccttttgcatgttagacagatatccactttgtctgcaccagagcggatgggttaggacagccaagtaccggctgctgcggggcctgcagttgcgtctcaggttcctcgtctgtaaaacgggatgagaacagcacctgcctcacagagtccgcgtgaacatcaaaggtgcaggatgtttgggggctccgctcggcgtctccggcgatgaccatgtgataaatgacagttatgctgcccaggcgtcgtgggattgcaggcgatcccccagggaccaaggttgactgcgagggcagacatgggggcctggcgacgagagcaccacagtgcccatcccaggctgcatggttgcgtgtggtgtccctcacagggtgtgcccttctctgcttccctggccctgccccatccccactgtcctgttcagggaggaccatacagggttccccaggctcccattcaggtggcgccggggcttctgactgagcctagactctgtgtgccccgcggcaggaaagctggggaaacgaaggcccagaggggactctgtgcttcaggagaggcaccccgagacaggacggggtgagggttctgttcaccgccttcccctggggagggagctggggatgcacaggtggttctgagtcaatccgccggggtcacggctgtgctggggggccggagccccccccctgggaaaaaggggtcaagacagcacatttcaggaagcaagggcccaagctggcgggcaggcgcagtcggagagggaggaaggtgtgatggagggcagctggcggtacaggggtcccctcgagacctcgcgtggggccctggaacttggtgatatgagcgtccagcacacagcatgtcaggcagccccagacccggcttccttgtccatactggaggcggctccctgccgcacatcccgggcccctccccccagggccttgagcgccagggccgctctgggctccagctgctgccagccgtctggggcccagctgttgtgtgctggcctcggccgccccgccccgcctggccacctgggctgccctgcgccccagctgctggcctctgaggcccaagtgagcagggaagtgaggcgggccacccgcttccccatgtggctggctgttgggggaggccgccgcttcccccttggctggctcttgggggaggccctgctctccaaccggctcagagtgggggaggtgccgaggccaggcggtgccgtcgcagagcatggcccctttttggtttcccccaacctccttttctggtcaccccatccatcagaaggacccttcttggcctcatatcctgggaccttgatgagccaagtcccttgtcaggagctgctgtggctctcgcccaggtccttggaggggcgaggggggcccctgggcggggcggctgctcctgggcttggtgttggggctgccctctccctggccccagtgcctgggagtgagtggcctctggattccctggtggaaaggatcggccttgccctaggatgtccttcacccaggtgagagctcctagagcccagcggggaggccgaggctgtcatttttggacccaggtatttggcgggatctgcccctcttggcacccctgcagctgagctccgccccatcccgcctcctccctacggcttcacccggctggtgccaacatgcagcctactgggctaaccatggagtggcagggccaccagggaaaggccaccctccaaagctgggggaggaagggcatggggatgggggagtcccagctcatcagtggagatgccgcctcttgggacatcacgcagacagtgtgtggctccttcctggacaggtgagggaggctggaggtcaggctcccgggtgccaaggggaggggcagagaggctggtcctttgccctcccagctgccaggctccaccgccctcacgagctgcaggccgcggcccccacccgtccagcctgctggtccccacgctcctgctcctgccgcaacagcggcagcaggccagggaggccatgtgaccttcgctcgccctccctccctccctgtgatccccacgtggcctctggggaggcagaaacaaaccctcagatcttgccactgggaacctttcagcgccagcgacatcaaagaggggcggcggcggcgggggcggccggcggatgcttctcttaaagggccacgccacttttaattcaaagcagatcctgggagcagctgtctagctgctgtctgggagggaaggtggcagccgagccctctccagacctggctgcagttgctccttagaactagttcaaccaggctgggtgcggtggctcaagcctgtaatcccagcactttgggaggccaaagcagggaaaacacgtgaggtcggaagttcgagaccagcctggccaacatggtgaaaccctgtctgctaaaaacacaaaaatcattacagaaagaaaactcatgggatgaaaaaaaaaaaaaaaatcagccaggcatggtggtggcgcgtgcctgtaatcccagctacttgggatgttgaggcacgagaattcctttaacccaggagatggaggttagagtgagctgagatcacgccactgcactccagcctgggtgagagagtgagactctgcctcaaaaaaaaaaaacaacaaaaaaaaactagttaaaccggagaggggtggggacggagaagaagaaccagcactatgccgcccttagaactgaggctgacaaggtcccaagtggccagacggcagcaaggtagaaactagattcgtttaatgaaataaatagtgtgagccctctcgcacatttatgtatgagctgcgattcttttatgattattatttttagagacaaggtctcactctgtgttgccaggctggactgcagtggtgtgatcacggctcaccgtagccctgaactcccgggctcaagtgatcctcctgcctcagcctcctgagtaccttggactacaggcttgcaccaccacactcggttactttttaattttttttgtagagatggggtctcactatgttgcccaggctggtcttgacctcttgggctcatgtgatcctcccccttagccaccctagatgctgggattacagccgcatgtcaccctgcctggccctgaggtgggattgtgaacctgcccaggtgtctgtcctgcctagaggccactgactgaggctggaagtgaggcagctccatgagccacaggaaggttccctgaccacctcccattcatttgcctgagccctgtcccaggcacggggacatggggccgggatggcaggtgcacctttgcagggcttgtcttctggaggaagcagatgctgaaaagtagctgttcaaggagctccctgacagggtgacaggggaagggaagacaggaaagccaggcagaagacagcccctgtgctgggcattcagtgggcctggcaagggcctgggccagccctgggattgactttgtgcagccttcggggaggaacccaaactcatcttctggcctggctcaggcttcctgcagcccaccggggactcactgcctgcaatgacctcttggccttcctgtgccaagtcagggtccactcacctgcctggagggtgctacaggtgaggatctgaggcctgggcaggcgaggctctatgttggaggccagcacagaccaggtcaaagttcagttcggtgcaggtagggggctggacctggtgcctggaccattccacgcctggacactgtggcctcccatgcaatgtccagcagtgagcactttgtgcttttgacttagtgcatggtggagaagagtggagtcataggtggccgcagagtggggtcatgcgtaaatctttgaaaacgtgggtgggctgcagtgataacagcaaaagagactgtgatatcctgtggtcacctgttgtataaggaggaagataggttaagaatctacatctggctgggcgcagtggctcacgccggtaattccagcactttgggaggctgaggtcagcggatcacttgaacccgggaggtggaggttgtggtgagccgcgatcacgccactgcactccagcctgggcaacagagtgagactcagtcaaaatatatatatacatatatacatatatatacatatatatacatatatatacatatatacatatatatacatatatacatacatatacacatatatacatatatatacacatatatacatatatatacatatatatatacatatatatacatatatatatatacatatatatatatatatatttgattccaaagtataaagacatggcctgacctgtttcttctcccactcatcctcatagaaaaccattttcttttttttctctttttagagatggagtctcgctctgttgcccagcctggagtgcagtgttgtgaccacagctcactgcagcctcaaactccggcctcagcctcctgagtagcttggactacaggcacacgccaccacgcctggctaattttttttttttttttttgagacagagtctcactcagttgcccaggctggattgcagtggctcgatctccgctcactgcaggctctgcctcctgggttcacaccattctcctgcgtcagcctcctgagtagctgggactacaggcacccgccaccacacccagctaatttttttgtattttttttttagtagagacgggctttcaccatgttagccaggatggttgcgatctcctgaccttgtgatccacccacctcagcctcccaaagtgctgggattacaggcatgagccactgcgcccggccaatttttttttttttttgagacagagtctcgctctgttgcccaggctggagtgcagtggtgctatcttggctcactgcaacctccgcctcctgggttcaagcaattctcctgtgtcagcctcctcagtaactgggattacaggtgtgcaccaccacgccgggccaatttttgtatttttagtatacggggtttcaccatgttggtccggatggtctcaaactcctgaccttgtgatctgcccatcttggcctcccaaagtgctgggattacaggtgtgaaccactgtgcccggccaagaaaaccattttcgttaacttctagggtagcctgcttgtttttctttttgcaaagatgagcaaattcctgtgtcaggtgccaggtgggcacatatgtagattttttttttttttttctgagacggagtcttgctctgtcacccaggctggagtgtgagtgcagcggcaccatctcggctcactgcaacctccacctcacgggttcaagagattctcctgcctcagcctccagagtagctgagatgacaggcacacaccaccacgcccggctgatttttgtatttttagtagaggtggtgtttcatcatgttggccaggctggtcttgaactcctgaactcaggtgatccacccgttttggccttccaaagtgctgggattacaggcgtgagtcaccgtaccgcacctgaatcaaataaaccttttgaacaatgaaaatatagcactataaaaaaggatgaagaaaaaaccccaaatttagtaaaaaacaaaataaataaatgtaacctaaccgtgcatcaaattgttaaacggacctaacctacctataatggttaattgtatgtgtcaacttgaccaggctaagggatacccagagagttggtaaaacctcatggctgggtatgtcttcaaggatgtttctggaagaaattagcatttggatcagtggcccaagaagatccaccctcaccacagcgggcaggaatcatccaatcagttgagggcccaaatagaacaaaaaggtggaagaaggacacattctctcttcttgagctgggacgtccatcctcctgcccttggacattggagaagggcaacctgcttctcaggcttttggactccaggacttacaccagccgcccatcctacacttctggggcttcaggatgggagttacacctctcgctcccctggttctcagacctgcagacttggattgaattaaattatattgtaattatattataaaccaatgtattgagttatacactggttttgggtattgagttatacactggtttgagtattcagttatacactggtttataatacactggttttcctgtctcaagcttgcagacaaccgaccatgggacttctttctcagcctctataatcatttgagccaattcccataatacatttcctcttttttttttgagatggagtctcactctgtcactcaggctggagtacagtggtgtgatctcggctcactgcaacctccacctcccgggttcaagtgattctcctgcctcagcctcccgagtagctgcgactataggtgtgcagcaccacacccggctattttttgtgttttcagtagagatgaggtttccccatgttggccaggctggtctcttgtatatatctgtgcatatcctattggttctgtttctctggaggaccctataatacactaacctaacctaacacagaaaagcaaattaattcaaataacttttgaacacaatactctatgtttctttaatgggacatactctaaaggacaaaaatagctacaaagacatcttgaaatttccacagtagatctgttgttaatagcaagattgccgcagtacctctgaaactatttggagggcattttagaacaaagcaaatgaataaatatactgatttactgacaattagggttctcactgcggacaaaggaggtattaggttgaaccatgtaggttttgtcatttttttgtagatcaaaaatgatcggctgggcgcagtggctcatgcctatctataatcccagtactttgagaggccgaggtgggaggatcacctgaggtctggagttcaagaccagcctggccaccacagtgaaaccccatcgctactagaaatacaaagattagctgctcatggtggcaagcgcctgtaatccaagctattcaggaggctgaggaaggagaatcgcttgaacccgggagatgggggttgcactgagccgagatcgtgccactgtattccagcctgggcaatagagcgagactctgtctcaaaaaaaaaaaaaaaaaaaaaaaaaaaagcctgggtgcggtggctcacacctgtaatcccagcactttgggaggccgaggcaggcggatcacaaggtcaggagattgagaccattctggctaacatggtgaaaccctgtctctactaaaaatacaaaaaattagccgggtgtggtggccggtgcctgtagtcccagctactcgggaggccgaggcaggagaatggcgtgaacctgggaggtggagcttgcagtgagccaagattgcgccactgcactccagcctgggtgacagagtgagactccgtctcaaaaaaaaaaaaaaagaagataaaaaaaggttaactagggcaatttaatagaattcaaccaaatacaaatatggaatgagggaagaagggggagaaggctgaggtgtggcttagaaatattcagatgaattcatcacactaattgtgtcccctgagagggcccagaaagcagtgacatcccagtagccatgagcacactcagcacccagaacttggtctctaaatcccatttccttgtaaaagggattggggtttctctgaaaaatggctgacttcagggcttgggcagagaggagatgcccaaagaataatggaaatgccaaaaggatgcaggaaagatgtccacacttggacaattaactgtggattaactcagagtatgataccaacattagatttcccaattttgtatgaaattatggtggctatataagagactggccttattttatttatttatttttttgagactgagtctcactctgtcgccaaggctggagtgcaatggcgtgatcttggctcactgtaacctccacctcccacaatcaagcaattctcccacctcagcctcccaagtagctggaattacaggcacctgccatcacgcccagctactttttgtattttttgtagagatagggtttcaccatgttggccaggctggttttgaactcctgacctcaggtgatccacccgccttggtctcccaaaatgctgggattacaggcgtgagccactgcacctggttgagactggccttattcttaggaaagagaaaaactgaagtatttagtggcgaaggtgctcaatgtctttactgcagcctcgacctcctgggctcaagtgatcctcctgcctcaatctctcaaatcgctgggactacagggacatgccaccatgcctagctaacctttgtattttttgtagagctggggtctcactatgttgcctagggtggtctcaaactcctaggctcaaatgatcctcctactttggcctcccaaagtgctgggattataggtgtaagccactgtgcctggccagaaaaagtttttacatgtatatggagagagagaaagagaatatgataaaacaaatggggtgacatgtaaacactgatttatctggctaaaagatatacaggaggctgggcgtggtggctcacacctgtaatcccagcactttgggaggctgaggcgggtggatcacgaggtcaggagattgagaccatcctggctaacatggtgaaaccccatgtctactaaaaatacaaaaaattagccgggcatggtggcaggtgcctgtagtcccagctactcgggaggctgaggcaggagaatgatgtgaacccgggaggcggagcttgcagtgagccgagattgcaccactgcactccagcctgggcaacagagcgagactccgtctcaaaaaacaaaacaaaacaaaacaacaactagctgggtgtggtgctgcacacctgtagtcccagctactcgggaggctgaggcagaagaatcgcttgaacccgggaggcagaggttgcagtgagctgagatttcgccactgcactccagcctggcgacagagggagactccatctccaaaaaaaaaaaaaaaaaaaaaagatatacagcaggaattcttgcttttgcaaacttttcttctctttcttccttcctcctccctcttcttctttcttctccttctccttttttgagacggtatcgtactacgttgctcgggctggggtgcagtagttattcataggcatgaatagtggttcactaaggctggaacttaagtaattctcctgcctcggccaccggagtagctaagactacaggtgtgagccaccttgctcggctaagtttgaaataatatcaggataaaagatcatccctcctatcaaaaaaagcataggagccagcttaaaggaggtctcactggccaaattcggaccaatttgagcatcaaaaagaatgctgactgaatgaaaaaaatacatgaattcatattaataaatatatatatttcaagatggggtttcactcttgtcgcccaggctggagtgcaatggtgcgatcttggctcgttgcaacctccatctcccaggttcaagtgattctcctacctcagtgtcccgaatagctgggattacaggcacgcaccgccatgcccggctaatttttgtactttttttttaagtagagacaggatttcaccatgttggccaagatggtctcaatctcttgaccttgtgatctgcccaactcagcctcccaaagtgctgggattacaggcgtgagccaccgcgcctggccatatttaatttttttttttttttttttttgagacagagtcttgctccgtctcccaggctggagtacagtggcgtgatctcagctcactgcgagctctgcctcccggattcacgccattctcctgcctcagcctcccaaatatttaataactttttaaagaaggggaagcttgaccgaaagtgactataaatgtagaagaaacaataaacttgggaagccatgattttgcagctttacggtttaacactgaatctactcattaactgatgctaaaactgttgggcaaatggttattgggaaaacttgatgcttgtggtctcagagaatgacctcacgcatgccttaattactccacaaggagccacggaccttgaccatggaggaattcagcagacccaaagctgaccaagtggttcaacttcacgtcctcactcatggccacgctgatgtcctgcacctcctgctgacttgtcacctcccttcatcattgccccaaacgtttaaccaaggatccagactgtgggacagtctaaggaaaataggaacagactcttcaaaaacgccaataaagaattaaaacccaccaggtgatgtgtggctcagtaaggttctgaggttgcacagagcatgggactggctggctggatgggagggctatggctagcctggggctttccccaggtttctccaatgtacatagatgtccgtgtttgtcagcatacaggtgtgtgtgggtgacatggatatgtcatcgacaggaaggcacaacagcacccatgcagagatgtccttagactcagcaatgactgccgggtgcggtggctcacgtgtgtaatcccagccctgtgggaggattgactgataactgcaccagttcccccttccacaggctactgggcagctgagccctagccaggagtccgcagagacaggcaggcacatggagagaggagtgccaaggcccggctgagccatggaggtggggggcggggcggaacacgtgcgagtgctgtccatgagtggcccaggtgctgggagctaagcacattcgacggctgcgagtcaggagggcagctccttctggaagcctggagctggtgaggccaggtgctttccctgctgcggtggctggcgatgggagtgtttcctgaggctgccaccaagcccctcctcagcatgggttggtgcgggaagtccttgagtgcctgtgggtcggcaggagctccggtgagactcaagttcgctcaccccacggttctgaaaccggtctcccgcctttcctaccctcaggtttagggaccgtcgcggcagccctagggctgccagattctgcactcccattttaggatgaaagaaatcaggtctagactgagggccacgagtcccaacacccagggaggatccgtacaggggcggggggactgccccaaaccataaggtcaggaggtggacgctgaccacagggacaggtgggcagggaagaggctcagctgctggagtggaggaagccgggagggtcgggggagagcagggcaccgagctggggacgtgtcagggacgaagcgagggtgggcgagcgcggaccgctgggaccccggggctcagtgccgctcaccgggggtgaccgcgcgcccagccccggcccagcctggccccggcgagcccatccaagccgcgcttcccggaggcagaggacgaccgcgctttccgggtctggcgcgggctttggcggcccaagggcggggccggggcgccgtgggtggggaaagggcggggcctggcaggacccggaagtgcgctgcggccccgccccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggtgcggccgcccgcccggggcggacgggtaggcgggcggggggcgctgcgccgaggccccgcccattgcggtcggcgtcccggtgttcgggggcggggcctcggcggccaatgagcggcctcctgagcggcggccccgccccctgctcgccgtcacctgcgcttccgctggggtcccgggggtcccgggggtcccgagtgggggcggggcggtggcgagccttcccaggggtgaggtagaacggcgccgcgtgtcacccgcatcgagtactcggcgcccggccgagcccagctcgcgagggcgccgggaagagggaggagtggagccctagacccgcgttcccattccggggcgtcccccggagcgggagcccgggttgcgcggtggcagatgtcccggccgtggggcctggaagcgatttttgccgagtcactcactgcacttttacttgggcaccttgtgaccgcgaatcaattaaatgtaaaagtattggctgggcgcggtggctcacgcctgtaaatcccagcactgtgggatgccgaggcgggtggatcacgaggtcaagagatcaagaccatcctggctaaaacggtgaaaccccgtctgtactaaaaaaatacaaaaaaatttagccgggcgtggtggcgggcgcctgtagtcccagctactcgggaggctgaggcaggagaatggcgtgaacctgggaggcagagcttgcagtgagccgagatcgcgctactgcactccagcctgggagacagagcgagactccatatcaaaaaaaaaaaaaaaaagtatttattgagcctctgctgcgtgggggaccgtgaggatccgaaggtgcacacgactcggagtttgcgggagcagcccacggcgtggggtccccaggcctgggcaggtggagggcgcagccaggaggctgttggtgccaggcgtgcagagtgcggaagtggggcgctcccgcagaggctgcgcgggaccccttggtgcaaggccacggctttggctttttatggagaagaggggcggaggcggtgcaggcagtggcagcaggtgcacagaaccgtgccagagccagggggtagcttgtgctaggcaagtttaaggcaggttgcagaactacagggtttgaaggagagcccagggtgtgtgccaggaagatgcccgtgttgctgtactgcaggggaactctgagtggagctttcctacaaaactgaggggatggtgaagaagggagggagagtggacaggatttgcaggtgagagcctgcatttgttgcggggaccgtccatagtgtggtcttgtgcttggctttgcctgggcagagccacctggctcaccaggaagctgaatgcccttggctgacctggcccactgcgcccgccagccctgcacactcagcagttcaccatcctttcatctcacccccaggttctggaggacacgtgccggcggcaggacttcaacccctgtgaatatgatctgaagtgagtttgctccagctcagcagcagggtctgagtatatctgtgcccctgccccctgaacatactggctctcacttggaaaagcccccaggtggttttaaacagtcatatattccctcccaactctggagacccaaggccttggcagggccacactctctccaaatgccctaagggagaatccctcctgcctcttccagcttctcatggctccaagcgttctgtggcttgtggccgcattgctctctgcctccgatttcttgtggccttttcctgttttctctgtgtctcaggaagacccttgtcattggatttagggtccacttggataatctagaacgatttatcattacatcttcaaagaccaggatccctagtaagatgttcagaggtcctgggggtgaggacattgacccatcttttttgggggggccaccattcaaccccctgtaggttttattgcattgagttgcataagttcccagtggggctctgaggggaaagagctggccgtggagaaataggatgccttgaaaactgcaggtggatccctgcagtctcacagcccctggaattacacgtacgcttctgtgtggggatattgttcccaagagagggcttctgccagactctcaaggagtctgagacagcagaagggtcagagccctcatatggataggatgtgcgtgtctatcccacacgcgaagcttttcactttaaagtcctgttttctggtgttttttttgttttgttttgtttttgagacagggtttcactcttgtcgcccaggctggagtgcagtggcacggtcttggctcactgcaacctccacctcctaggttcaagtgattctcctgcctcagcctcccgagtagctgagattagaggtgctcaccaacacacccagctaatttttatatttttagtagagatggggtttcaccacattggccaggacggtctagaactcctgaccttgtgatccgcctgccttggcctcccaaagtactgggattacagagatgagtcaccatgcctgcccttgaagacctgtttttacagtactgttgtcctaacactgggggcagagggcaggagcttgccctcctggcattgcccaccctgccttacgaggctctcctgggaggagtttcttaggggtgatacctgccaagtcattccagtcttctaccttgtgtctggaccacgtgagaatcccaggacctgtgctctgaatgccaggtggtcttgggctttctgccccagaccttcacaccatccttctccagtctctcttgtcaactgaagaatgcggttcatatgtttggaaaggagggctttatttctcataaccggttgcagcttgcagggtggccattctaacaggctgggaagtgtagcctccagccagaagctggaaacagacacttcaagagagggaagaataagacagggatttacaccgaatggggtggctgatacagacgtacttaatacgctgtaggaggatcatgagtattcatgaaaggagaactgtgcacacagttgagcttcctgcctcttcacgggtcctatgtgcaaaaaatggcagtgccagcatgacctgagggtggaatttttggcctctgaagtcagaggtgaagcaggctgggtgaagtggctcatgcctgtaatcctagcactttgggtgcccgaggcggaggattgcctgagcccaggaattcgagatcagcctggggaacatagtgagaccctgtctctacaaaaaaagtaaataagtaaataaataaataaatggcaaatcagaggacatgaagactgtgccacgaaaaccctgactgtgccagaaccactccatggttggtggtttcttatcaggaaatacctgtgggttgttttgaagaaaccgcaagagagaagggcctggcgggaggttggctgatgtcagataccagcccaggggtctttggaaagggctgctttctgtttatcccttagggaagagagcctgcagatgtgtctgatctcccacccagccatggccaggaactcagctttcaaggtttctggggtcccctgggccaagaggaggctggttcagttggttggggggggcttagggtttcatttttatttcttttttattttattattttttgaggtggagtctcgctctgtcacacaggctgtagtacagtggcgctatctcggctcactgcaacctctgtctcccaggttcaagtgattcttctgcctcagcctcccgagtagctgggattacaggcgtgcgccatcatgcccagctaatttttgtatttttagtagggacggggtttcaccatgttggtcatgctggtcttcaagtcctgacctcaggtgatctgcccgccttggtcttccaaagtgttgggattacaggcatgagtcactgtgcctggccatttttctgaaacagagtcttgctctgtcacctaggctggagggcagtggcatgatctcagctcaccgcaacctctgcctcccgggttcaagcgattattgtgcctcagcgtcttgagtagctggaattacaggcacgtgccacgcctggctaatttttgtatttttagtagtgacggggtttcaccatgtggaccaggctggtctcaaactcctgacctcaagtgatccgcccgtcttggcctcccaaagtgctgggatgataggcgtgagccactgcacctggcctcatttttctttcttttttttgagacggagtctcgctctgtcgcccaggctggagtgcaatggcgcgatcttggcacactgcaacctccgcctcccgggttgaagcactcctcccacttcagcctcccgagtagctgggactacaggcctgtgccaccatgcctggctaatttttgtatttttagtagagacggagtttcaccacattggccagactgctctcaaactcctgacctcaagtgatctgcccgtctgggcctcccaaattgctgggattacaggcatgagccaccgcgcccagcgcattgttacttctcagtgttcacctgcccgtggtctgtgtggtggtgtctggtgggaaccagtgagtgcgattttgaggcaggtcctgcaataccatagccatgttttcaggtgcccttttcctctgctaatggtaccacttgcttacaaagtgcagccggtgcagaggaatgcagccccaggcgtgaacagtgccctccgctccaaggttcccagcctgcctgccctcgggatcccccgatctgctatcctgtcttgacgtagacatttcatgtggcaatttccagactcacttttctggccagtgttgatatagcaaagtttgttctctcttaattcttccagatgcccctgggctgtctgaactctcttcactagttgtctccgacagcagcttgcatttccaaagtgaggccaaccactttgagtatattcagatttttcttttcttttctttctttttctttcttgttttctctttctttctttctttcttcttctctttttctttttcttcctttctcttttcttttcttttctttcctttcctttccttttttctttcacagagttttgctcttgttgcccaggcaggagtgcagtggcatgatcttgcctcactgcagcctctgcctcccgggttcaagcgattctcctgcctcagcctcccgagtagctgggactacaggcctgagccaccatgcccagcttatttttttgtatttttagtagagatgggatatttttgtattttcagtagagacggggtttcaccatgttggtcaggcttgtctcaaactcctgaacctcaggtgatccgcctgcctcggcctccgaaagtgctgggattacaggcgtgagccactgcgcccgggcagtcaggttttctgtggtggctccagccgtgacggccggggtctgtgacactccagcttccgcgagtgcagcagtgttcacgccccagtcgttctctctgtgttttccgagcgtctgcactggggctgtcagcaccccagactctgaaggagcagccccctcggcgtgcaccgaggcccacatctccctttttcctgctcccttctgcttgcaggaggccccatatgatcggggacccgccttgtgcctctgcaggtcatgacgtcccgctgttggggagctgccacaggacgtggatggcggggcgtggatggcggggcgtggatggtgggacggggatggcggggcgtggatggcagggcgtgtcaggctctgcagggcagcaagtgtgctctggtctgtcttgcaggtttcagaggagcgtgctcgacctttctctccagtggagatttgccaacctgcccaacaatgccaagctggagatggtgcccgcttcccggagccgtgaggggcctgagaacatggtgggtcgtgctctgggggaggctgactgtgtggggcacaggatcgttcagctggccagggacgggggacgggacagtggggggtgctggggaaggagggacatgagtcttagcaccagttctgccttccctgggttgggcccaaacagcttcctgttttttgataactggcaactgaaaatgagcatctcatgtttttttttttttgagctggagtctcgctctgtcgcccaggctggagctcagtggcgcagtctcggctcacttcaagctccgcctcccgggttcacaccattctgcctcagcctcccgagtagctaggactacaggtgcccgccaccacacccggctaatttttgtattttagtagaggcagggtttcaccatgttggcctgctggtctggaactgctgacctcatgatctacccgcctcggcctcccaaagtcctcccaaaggattgcaggcgtgagcctctgcgccccgcccacgtcattcttcatgtggaagtttttctttctttctggggtcagttgtgccttccctggctcagggtgtcagcagcattcacccaccagcctgaccacctgctcatagaattgcccagaatgttagagccgaaagcgctgcatggatgccgcaagggcagcctgtaatcccagcactttaggaggccgaggcgggcagatcacctgaggtcaggagtttgggaccagccggccaacataatgaaaccccgtctctactaaaaatacaaaaattagccgtgggtggtggcggatgcctgtagtcccagctactcagcaggctgaggcaggagaatggcgtgaacccgggaggcggagcttgcagtgagccgagattgtgctgccactgcactccagcctgggcgacagagtgagactttgtctcaaaaaaaaaaaaaagagcagcaaacatttaccatctcatgtggcttctgagggtcaggaatctgggagcagcttagctcagtgtctgtcctgaggctgcagtcaggttcggtggagctgcaatcttttgaagcccccactgggacacgaggactgtctccaacacagttcactcctgtggcgcctgcatgtacccacacacacccacacacacccccacacacccacatacccgcacacccgtacacacccccacacacccctgcacacaccccacacacacctgcacacccccgcacacacaccccccacacacacccacacacacccctacagcaacgtgcacacacccccacacccgcacacacccgcacacaccccacacacctgcacacacccacacacctgcgtgcacacccccccacacacctgcacacaccgcccacaccaacatgcacacacctcccccccacacacacccacgcacacacctgtacacacacacctacacatctgcgcacatacccgcacacacctgcatgtaaacatgcacacacacgcacatctgcacgcacatgcgcacacctgcacacacccacacaccaacatgcacacatccacacacatacctgcacacaactgcacacccccgcacacacccacacacacatatgcacacacgcacgcacacctgcacatacctgcacactcacatgcacacacgcatgctggtgcagccctgccggggagcctccaaggccctcactccagagtgaataggagggtagccttctccgtgggggtcagcctctccctggaggccagggcggggcagtcaccctctctgtgtctggagaatcagtctgggatttagaaggaatagttgcttttcttcctaaggaagtttctcatgtcttataccctccaggttcgcatcgctttgcagctggacgatggctcgaggttgcaggactctttctgttcaggccagaccctctgggagcttctcagccattttccacagatcaggtgagcatcagtgggctgggggctcttccctaccctgtttgctggggaagctgctgtggttactgggtctggttcagagctggacacccaagctctgtgctggcctgtggtgcctcttggcactttgcagtcctttgtagaggaggggtgtgtgggctgccggttcatgagcagcagcctcggggatggctggtcacagctcatcgttctgagtttcctgggcccagcggcccagccttgcccacctagaagagcaggaatgtgcttctgtccttgtgggggcctggtgagcactaaggggagacgttcggtgctgggggcagggctccccatgcttgattcccctggatgggatcataaggtctcttttttttaagaggcagggtctcactatgttggtcacctaggctgctcttgaacccatgggctcaagaaattctcccatctcagcctcccaaagcgttgagattacaggtgtgagctcctgtgccccaccagaaaatcttcctaatagtaattggatggctgggcacagtggctgggcacagtggctgggcaaagtggcttgcactttggaaggccgaggctggcgaatcgcttgagctcatgagttcaagactagcctcggcaacatagtgaaaccccttctctacaaaaaatagaaatgttaggccaggcatagtgcatggtggtgcgtgcctgtggtcccagctatgccagaggctgaggtgggaggatcacttgagccgtggaggcagttgcagtgagccgagatcgcactgctgcactccagcctgggcaacagaacgagactctgtctcaaaaaaataaataaataaaaataagtaattgatgtgtatcagtttctgtcggttaatggtttaaacgttgttcctgaatgtgtaaaaattggtgctttgtcaatttgggtcttttcatcgttggctggaagtctctgtccacagtaaaaggctcagcagaatggaagggacttggggctggggtttgctgtgagccagggggttctcgccctccccgggcctcagtttcctcacctgtgccccggctggtgtgtggatggggtgagttcatgtcttgaggaccgagcatagggcctgtgggaaggtgaccgcgcgtcgggcgctgggaaggtgactgtgcgttgggcgcgcttggtggccccagggctgggcctgctcccgtctgacagtagtgccgcgctgcatggcacgggtgttgcgttcgtgggtgagagcgctgaggtctgcacgtcgggtctcagtggtcatggggatggaagccaccccagtggctgtcggggtgaatggaggcccctggagatggcagcgggttaagcacgagcacggaattctccctcccaaaacggaactcagacaacagtgacggagcctaagagcaaagccaaagccacgggcaggggtgagcgggacccgaggcaggagatgacggagcctaagagcaaagcgaagccacgggcaggggtgagcgggacccgaggcaggaggtgacagagcctaagagcaaagcgaagccacgggcaggggtgagcgggacccgaggcaggagatgacggagcctgagagcaaagcgaagccacgggcaggggtgagcgggacccgagccaggagtggcgccgggcagggaggcaggcagccccaggcgctgtgtgggcactgggtgagaagcagggatcccggcgccctggctctgtgctgcttcctgagacgagagtggcagagggcaagaagaaaaccaaacagcgcggggaacagaagtcaggaaagatgaacgtctggaaggaaatgcccctgggccgggcggtgcccccgggcgtgaacagaatccagtgctcccacaggcacaggtgcttggtgagggccgtcctccctggctgtgctgtcagtcctcagatggggatggaggtaaggaaatggcccagagtggcctggggctgccactggggaggggccgagggtgtctggagaggtggggccggcattgtggtagcataagcctcttcaacagactttgtaaacctcgtgtgaaacttagtttaagaaacaacaggcttggccaggcgtggtggttctggaagtggctttggagctggctttggtggtggctgtgggggtgggtttgggcgctttggaggaggttgcagtgagccgagatcgcaccattgcactctagcctgggtgacaagagcaaaactccatctcaaaaaaacaaaaaaacaaaagaaacaacaaggctgggcacggtggctcacacctgtaatcgcagcactttgggaggctgaggcgggtggatcacgaggtcaggagttcgagaccagcctggccaatatggtgaaactccatctctactaaaaatacaaaaattagccgggcgtggtggtgggttcctgtagtcccagctactcaggaggctgaggcagaagaattgcttgaacccaggaggtggaggttgcagtgagccaagattgcactcagcctgggcaacagagcgagactctgtctcaaaaaaaaaaaaaaaagaaacaacagaagtggctgggcgtgatggctcacgcctgtaattccaaccctttgggaggccgaggtgggtggatcacctgaggtcaggagttcgagaccagcctggccaacatggtgaaaacccatctctactaaaaatacaaaaattagctgggcgcaatggctcatgcttgtagtcccagctactcaggaggcaggagaatcacttgaacccgggaggcggaggttgtagtgagctgagattgcgccactgcactccagcctgggtgacaaagcaggactccgtctcaaaaaaaaaaaaaaaaacaagagcaagtggggcagctctttcgagacaccagggacagcaggaggtggtggggccgttggtggtaaagcccggagcccccagcctgcggccctggtctgtgtggcagtgtgggtctgtctgcgggtgtgtctgcacgtacacctcatttgatgaacactcacacctgtggtggagagtgatttgtggctgactgttgttgctggtgaatatgctgtggacatcttcctgaagggtcccgcacctgtcactcctcacagccatgctcttccgtcgtgtgggtgtcatgtgggtgttgcggggcatctggctgtgtctcagggcatcccgggcagggttgcagcagagtgtgcagctggaggcctttgcacctggtcacccaccccagcttctcctgtgggctaaattccagaggtggaatttaagatagggcttcttcacatttcatttccaggccgggcatggcggctctcacctgtaatcccagcactttgggaggctgaggcagatggatcacctgaggtcaggagtttgagaccagcctggccaacatggtgaaaccccgtctctactaaaaatacaaaaagcagctgggtgtggtggtgagggcctgtaatcccagctacttgggaggctgaggcaggagaatcacttgaactcaggaggtggaggttgcagtgagccgacatcacaccactgcattccagcctgggcgacagagcaagactctgtctcagaaataaatattaaataaatttctaaaagctcagacccaagctttgtcccagaagctggagtttgctaaccatggagcaggatatggacgaggtttcatagtgggtggcgttgccagccccacggtgagggtggagtgcctggtgggctctctgctgggagctggtccccagcaggtctgcatgagggagggaggctctcgtgcctagtgtccctgcactggcccaggaggcttggggaggccttgggaagtccaggtgtccgcagagtgggacgggcgggaagctgatgtttcttctttcatgtgtttcggaggaggtctgagtccagggacagtgtaggcgctgtgcttcgaaggggcgttctgaggctgggggctgcaggcctgtagcgtgcccaggagttgccctgggacagagcctgctttgtgtatttggggacccctgggtgatttccttggatggacactgccacgtgtttgaaacgttgcagctccactgcgagggtgtcactgtagcacgcagccctggcccgaccagcgtctcaagcagcaggggcctcagggataccagcgagccacacgtcggccatggaggtgactcacattttcttttctttcacccaggctggagtgcagtggtgcgatcttggctcactgcaacctccgcctcccgggttcaagcaattctcctgcctcagccacctgagtagctgggattactggcgcacgccatcacgcctggctaatttttgtattttttttagtagagacagggtttcaccatgttggccaggctggtcaggtgatcagcccgcctcggcctcccaaagtgctgagattacaggcgtgagccaccacacctggccaatcactcactttttcttgtaaccgcattaaagaagaaataaaaacaggtgtcattaattttagtaatacgtgtagttaactcagtatacccaaaatacgacttcctggacacgtagtcagtagaaaagtgagccgtctcatgctcttgttgtgcagagtccttgagacctgcatgtatggtgcacttggagcatctcggtctgggccgggtcctcgtggactgggcgctctccactctgcttctcaggctctgctgcagggagggcgtcaggagacagaggctgcacactgctggcttcgagctttcccattttccctatagtctgaaggttctgcccagcacagaggggtgtgaacagccacgccgagctctgggggacactgctctccgcctgcctggtgggcctgtgtctgagtttgggatcttccacgccgagctctgggggacactgctctctgcctgcctggtgggcctgtgtctgagtttgggatcttccacgccgagctctgggggacactgctctctgcctgcctggtgggcctgtgtctagtttgagatctttattacggggagtgtgccttccgtgataggagacgcatgagatggaaatgaggatttcatggcctacgggccctgggggtacacggccctcctggaggcacccggaggaggaaagggagtacctttctgaccagcatctttgctggggtacagattgttatgctaacgggtttcctatgaggagtttctctccatgggtttagagccagcaggcactagccccaggaggtcatactgtgactcgggggatactgtagcacgtctgggcagtccacgagggcaggcgggcgagtcccgtagtttgaatcccacgtcccgtaaggacctagttgccaagtggtgaaaggcaggggtgtggatggaccatgctgagctgctgggagcaggaagagaaccggggactgttgtgggtgaccgagacctgccgtggaacgatgccaagggtgagccgtgggaactcacacagcagctgagccgctttccatctgaagaccgtgagggagcagggtgggctttctgtaaatcagattcatgagctcagccatggaggggatttgtcctctctcagaggtgcccccgggctgtgctggcgtgggcaccccaggtgggagtggcccccagtgtgcccggcccctggctggatctcttcccaggcccccagccctctgctcccagccttgactcagtgcttgggggctggctgagtgcatctcagcctgttcctccttctgtaggtaaagccgtggctccgggaaagctgggtgatttctgcagccctctgggtgtgctggggtgtagggatgggctgctggtgaggacagggctctgccaggtggagcactggcctgtggccacactcagggtgggtctgtgcatgctgctgggccagctcagagctctgcggcccgtccctgtccatccctgcccgtccctgttcatccctgtccgtccttgtccattcctgtccatccctgtccatccttgtccatccctgtctggacctggctgggttgagaaggccggagcctgccccaggctctcccaggctctgtctagccgcttggcggctgggctgtcatgtggtgggtgatgccctctgcgggcctccctgagcccagtggctcctggcctgcagccacagcttctgttcccggcagggcgcatgctgctgcctgggctctcgtcagcacctgtgtttgcgcccggctttgtcatacccagacaggacatgaacacagagagctctagactcactgccttgtccccagcacacagccgcgccttgccggagcggggccccagcggggcggggtttgtggtgcataaagaatatgccctcgaagccagcagcagaggcgtgtctgccctcctggccgtcccgctggcttctggccctggccgggtggggagctctgctggctggagagtgtgtgagagtgtgccagtaccctgctgcgagcaggcacccgcggaagcgccccaaagcacttcttgcatttctggcttcggagcatggtgtctggtggcttggcctggcctggggtccccgggaggccctgggtcttgcccctgcggacattgggacttgcagaggtctgcgtgggggagggggagtaggggctgtgtctcctcgggcgctggaatttcccccgggccctggcgtcctgcacactgggccggcgtagaaggtctggaaccgattgcccaccacccctccctgagatcccgcatgagggagggaatctgatccctctggaggagccgcacatcaaagccgggctggcgtttgatgtcacgctgctgtgctctgtccctgtttgtgatttgaggtccccaagctggcggtcagtgccggggaaggactgtgagttgggactctggccacccctcagcccaggcctccccagccgtagagaagtggcctcatgaccatctccggacccctggccatctgtgtcatgctggggagcggggaccctgggccctccctgtcccccttcctggccctgggggctgtgcttccttgaggcctctctctgcctctgtccgggttctgctccggcgcattttgaggccttgtgttttcctgagccctgcgtctcggggcctctgggccgagtctccagccatttggagggaaggcaaatccaaggccctttgttggctgctctgtgggacgggagcttagggagtgtgtcccagcctgtgcgcagaggacacccgccgtgtgtgtggtgcgcacgtgctccacaggctagaggcccttggggaaggggctcccctgtaggcagtggacccagggagaccatggggctaagtccacgaccctgtggggcctctgcagccagaccaggctgtcagagtcggggcctgggtgggaaagggatgcccctcccccaggattgaggacgtgaaaaataaaggccacgaaacaaaagaaaacacgtcaaacccacacacgtggccgagtccccaggtgtcggggctgggcctgtcctgggtgtggcaccttgggcttttctgcttggtctgttctcatttcagggaggcaagtcctgcccttttttttgttttgttttgttttgtttgtgtttgagacggagtctcgctctgtcgcccaggctggagtgcagtggcgcgatctcggctcactgcaagctccacctcctgggttcacgccattctcctgcctcagcctcccgagtagctgggaccacaggcgcccgccaccacgcctggctaattttttgtatttttagtagagacggggtttcattgtgttagccaggatggtctcgatctcctgacctcgtgatccgcccatctcggcctcccaaagtgctgggattacaggcgtgagccaccgcgcccggctgagtcctgctctttcaagtaggtcagcagatcccagggtcggggcacggtgagtgcacagtggacccctgcggccctgtaagcacacaggtgggttcaggcggaggccgagagttcctgtcccagcatcccgctctgtgcatggatgtgcacgtatgtctcgacctggacactgcagcaccctgccctctgaccctcccagtaccccccatcccggagggttgctgcaagcagtttccagcccagctgttacctaatctttatcccctgtgttctggtcaccagctcagcctgtgtcttcctgtcccacctgagcccttgcaaggcacactggccatagggcctggcagggcacctgcatgacctgaggccggccctggcctcccctttgcctaggctctggccatctgccccctcctctcggattcccctccctggagagggactgatgaggggcatctgcaaggaaggcctgagaagggcttttgtttttctcagtggggaggatttcacggtggggagttggaaacgcagaggcaagcccgcctcatgcagcaggtgccaccagcagttcacatgctctggggctggatgtgacggcatgtgcccgtctcccgggctgccatgcacatcaggcatgtgtgggaggcgtgctgcatatacctgcccacccatgcacgggtccagctgtgcctcctgcggggcgaggctcagaaagacactggtggcagagtccgacatggacttataagcacggcctccccggccacaggcaagcgggcgtgagcggagtgcagcgcccctccctccatgcttcggtgacatcaggcgtcggctttgaaggaggacatcaggcggtggagacaggggcacctcctcttagtgggcggcttaagatgaaagcccagacgtcggtaccctgactctcaggctcctgagtacaggtgtccgtgagccgcattccggagccagtgctgctcgcccctcctgtgcggtccctgggccctgccggcagctccacgtcctgccagcggccccgagactggaggtctcggggggagcccccaggccacgcaccacaggccagggtccttgggagcgcccccggctgtcaggtgcctccttttggtggttgtggggcgcagtggggctgaggtctgtggcctgggcctgggcctgggacgctgtcctgggtgggtgctgggtgagggccccacacctttgctttccgagtctcctgccccagggcctccgtggcactggttgagctgccctggggtacctgatggtttctttcctctcctcccagggagtgcctgcagcaccccggcggggccaccccagtctgcgtgtacacgagggatgaggtaggcggcctgctcttgctcacccagtccccgctcactttcagcccactttccaactggaaaatctgctgtcccgcagccgtctccagggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaataaatatttgctttgctcggtgttttgatcattttcaaaaccgagtgtggcgtggcgcaagcaaagcccgccgtggcgggaccctcctagcgctcgtccctggcctcacaggggccttttgtttccacgctggctgagtgccctttgctggggtgggggggcactggcccggaggggccctggggggccaggacattccccgcatttatccccatttggaagctccctggctggggctgtgacggggaggttcaggtctacgtcctcccttgaggggatgagccacggggctcaggacccaggcccagcactgtcctgaggctgtggccctcagggacccttacaccctttggcttttgtgctgggccattgactgtgccctcgctagaggcagcttctccaccccttcctcacaggtcagagttagcgtatgggacgtggccagccaggcccgatccctgcccaccccgagctgagcaccaggaatggccacccccgtgggtgacagcacgttcctgcctctctcgctccgggcagtgggtcctggcaccagggcttcctccttgcagcccagctctgccagcccaggcctcagtgagcttgggtcccagctgcggagaccaggctgggggagacacggtcaggcatgggcagcaggtcctgccccggctgcagaccagactcaagctgggccttgtggagggtgtggaccggcaggggccagatgtggggggtgggtaggatggaggccagagagggcacgtggcctgtggtcctggtggtgccggtgcccggagggcttccctgggctctggggtcccggtgcaaggcgcacctgtcctggctgctcctcctgcaggtgacgggtgaagctgccctgcggggcacgacgctgcagtcgctgggcctgaccgggggcagcgccaccatcaggtaagggcagtgctgctggggccgaggagtctatttagctaaaaaaaaaagtggtctcaaaggaaaggagaaaggacacgtggcaagtggggagtaggtgtacccaggccctcatcatggagagcgcctggtggcctctgcctgcctgtgggcgtgggggctgggctgccccgacctcatctctgtgtcccccagaggggcggtggatcttgggagggcgcatggggcaggagagggtgaaccgggggcgggagagggtgagccgggggcgggagagggtgagcctgggccgggagagggtgagccgggggtaggcaccacaaggtgcttcccttgtcctctggccccactcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcgggtaaaaggggctctaggccttgggacttgggggtgtcctttctcctgatgtgtagccctgcgtggctttagctggtcagcctggtggcgtggccgtgatgcgggcagaggaacccaaacgcgcagaggaacccaaacgcggggctctggacaggagccttctgacttcgcccaggaaggaatttaggggtaagcaggtggtagagaaagtagctttactgagacggtggctgtgtctgctccgggatgaggccgtgtccgctccgggatgaggccgtgtgggctccgggatgaggccgtgttggctccatgacaaggcggcaactgtgtcagctccgtgttggctccgtgatgtgtggcacagagcagggccgccctggggtggtgcatggagggcagcagctcagggcatggccgtggtcacatttacatccactcaactacatgcacgttaaggggtggggcattcagaaatctctagaaaaggggtggtaacttccgggttatggccagggaagggggagctggtgaacgcatcagccagtcttcaatctggtctggaatcaagccccacctcctacctgagcagggtcactgggcttgttcttagcttctcaggcaaatgatttttttttttctgggtttttttttttttttttttgagacagagtctcactgtgtccctaggtgggcgtacagtggcgcgatctcggctcactgcagcctctgccacccaagttcaagtgattactcctgcctcagcctcccgagtagctgggactacaagcgcgcaccaccaagcccagctaatttttttgtatttttagtagagacagggttttaccatgttgtccaggatggtctcaatctcttgaccttgtgatccacccacctcggcctcccaaagtgctgggattacaggcgtgagccaccgcgcccagctcttttttctggttttaaaccacctttactgaggcacccactttttttttttttttgagatggagttttgcttctgtcgcccaggctggagtgtggtggcgcactttcggctcactgtaacctccacctcccgggttcaagcgattctcctgcctcagcctcccaagtagctgggactacaggcgtgtgccaccacgcccagctaatttttgtatttttagtagagacggggtttcaccatgttggccaggctggtctcgaactcctgacctcaggtgatccgcccgcctcagcctcccaaagtgctgggattacaggcttgagccaccgcgcccagcctaatttatttttatttttatttttcataaagacgaggtctctctctgttgcccaggctggtctcgaattcctgggctcaagcgatcttcttatctcagccacccaaaatgctgggattacaattgtgagccacctcaccaggcctgaaagttactttttataatattgtggatagtatcatgcttcctgttacatctttgactggctgactccttgctagttctagtggcgtcttggtttctgtcggggcctctgcagacctttccctttgtcctctcatcgtttttcttcctgtgttgcagcgaatgggcctctggtgcttttggatcgtggcgatcttagtagacatccttccttgtcttgatcgtaacaggaattactagtcatttctctgccaaggatgatgtgtgctataaaaagcctttatcaagcagagaaagttactattcctaactttctgacatttaaaaaaatcttaagtgggtgttgaaccgtttcagtgttttcagcatcaatggagatgaccgtatgctttattttattggcttgtgcatgtgtgttcataagtgagacagactttttttccttgctctgtcttcatccagtttgggaatcgaatttcacctggctcacaagggagctgggcagtggcccctcttttctgggttctggaagttctccgaaggttatggccactgctcactgcagactacacccaccactggggcactgggcccttggcggggagtgcatgcaggcaggcggccaggtgctgacctccgagcatgcctgtgtgtggctgtggcctgaccctctccctcacgcctccccccaaccgtggggacctcgtgtctgtggggtccctggccctgtggctgacttttcctttgtccctgtcctgaccccgcatcagagccctgcacctgggctgctgaaacctgacttcctcagcttcctcacctgcagaactaaggtgttcgtggcatttatgggttttgtgccaaaagaggcagactgggggactgtcatgcggctttcggtgacagggatgggaggaggctgtttcccagcccctgtgtcccctgagggccaggctgccagctgccagccacagcccaggggccaggtcagagcttcttgagctcctgctgacgtagtgggcctggaaggcccccatgcctccatctcctgtggacatttaaaatatttgtgtctgggcctgtggcatggtggctcacacctgtaatcccagcagtttgggagaccgaggtgggcagatcacctgaggtcaggagtttgagaccagcctggacaacatggcaaaaccctgtctctaccaaaaatacaaaaattagctgggtgtggtggcaggtgcctgtaatcccagctactcgggagactgaggcaggagaatctcttgaacccgggaggcggaggttgcagtgagccgagatcgtgccactgcactccagcccgggtgacagagtgaaactccatctcaaaaaaaaaaaaaaaaaagaaaacaagaagtggccaggagggctctgtgcacatggccccggcctcggctgtcccctgggcactcgtgctacgtgtcccggaactcaggtgaggtcaggagtttgcttcctcctcctctggccacttctgagtgaagcaacctcatgcctccctcttgcctcccggccacacacctgggagggcagaggccgggcgtctgcaccgtgttggatgtgggggctcccatctagcccggcgtcagggtccagcccctctgttttctgtccccctggctgtcctgggactgttcctgttgagtggacaagggagtggggagtgagggtgttgggtccattctaggactatgatggtgttggcaccccatcctccctctgggaactctgccaaactctgcactgtgacacctgagtccccatgaagcgctcgtgcccctcgacccgtgtgctccgggtgagcaggggctgaccccctctaggcctgctcttgtggggacccctcagtgtgagagacacagtggctgtcatgttcccccattctagaggcgtgggcctcagccccttccctccgtgaccagggcgggtcttgtctgcagagcgtggggcgtggagcatggggctcgcagcccagagtagtgcccgcccgtgctcgcccgtcgggaggcgctgttggggtggggtcttggctggcaggaggggtccaggggagggagcgtgtgcctggcctgcatggcgtgctgagggcctttgatctgggacttgggcagctgattgatggagggcgtcctgcctgccccgcgcctcccatcgccgccagccgcacacgcagagggcccggggccacatgccgctgctgggtccctttcagtgatggggggaggggagaagggaacaaaacagaacttttttggggaacttcaaaggtacactttagtaagcaaaaagagtttccaagtttcccattaatgttttgcctgtgtgtggtttttggacttaaataaagagtcagaaggaagagacaggataaaatacaggcaggtcctcggccgagacccggggtggttcacagacccgggcggttcctgcctttgatgtcaggcattaattattagaaggtagttttactggcgatcagaaccgggcgctgggagaggctggggctgcccggcgccccctggccctgtctttgaagtgcctccactggctgggaggctgccctgcagccctgtgctgggctgggacgccagtcccagcagacgccccccacaactcggcctcccggcagctggcacgagggccgctcctgatcaaaggctgggtctgcccgcacgggctggcggctgctgccctgcctgcccctcccgcctcgggggtgaaccttgctcctggagccggggcctggggtttcctcagcacccctgctcacacccggccctctgtggctgacagccggtgtgggactcgtggggcggggaggagcctgtcccagggttttgggggtaaaccagcggggaggaggctgggcctggagcgggtcatgcactgggcgtggtgaatacaccctgcctgggacccccgtgtgcctggcagggcaggtgctgttgaccctgggcagtaggtattgggccaggggctcctgcccctggaccctgacgccgggctagacaggagcccccacatccgacgcggtgcagactcccatccctgcggccagcacagtcagtggccagggtggcccaggtccctgctatgcctcatgggtgtctgaggacaaccctgggctctgaggctgtccctaggggcacagcctgtggccttgattggaatggccaccaagcgtggctggcagatggctcagcgactttgcaggtggctggctgagtcccggctgtttagaagcctggtgactgacaggcgcttgtgttttggtgaggaaccccggggggtagggggtggatgctcgccactggggctgtggggagaactgggagtgtggggctccgtactgggcgagtcggctgctgcagggcgcagaccccactggccccttctggcctggactctcctccccgttgggcccaagatcccctggttgggattgttccaggaactcaggtcaggggccccgtcagcccttcccgggctcccccaggagcagcctccagactctgccctgcggatgacccccctcaccaaactgcttttcctgcctgtccgggggtgttggtgcgctttatccacagtgacacacgcctgccacaccgtaacgtgcccagctccagacgggctcatggtcagcccaggctgcagcagtcctgaatcctgttcttatttttcttttcttttttttttctttttccttttttttttttttttttttttgagacacagtctcgctctcttgcccaggcaggagtgcaggggcacaattacggctcacagcagtcatgaccttccatctcagcctcccgagtagctgggactgcaggtgtgagccactgcacctggcctcttttcatcttctaaagtatttttctttttaaaattaaaaagtgatttttttttcttatgagtacctcatgctttatattttcatcttttcattttcattttattttattttatttatttttttgagacagtctcgcgctgtcacccaggctggagtacaatggcacgatctcggctcactgcaaccttcccctcccagttcaagtaatttttctgcctcagcctcccgagtagctgggattgattacaggtgtctgccacctgtaatttctgtgttctttgtagagaaggggttttgccatgttggtcaggctggtctcgcactcctgacctcaggtgatccacttgcatcggcctcccaaagtgctgggattacaggtgtgagcctctgtgcccagcctatttttatttttatttttattttttgagacagagtctcactctgttgcccaggctggagtgcggtggcatgatctcagctcactgcaacctccacctcccgggttcaagtgattctgctgcctcagcctcctgagtagctaagaggcgcctgccaccatgcccggctaatttttgtatttttagtagagatggggttttaccatgtttgtcaggctgatctcaaattcctgacctcaggtgatctgcctgctttggcctcccaaattgttaggattacaggcgtgagccaccgcgcccggcctgttttcatctttttaaaataactttttttttttcgagacagggtctgtctatgttgcctagcctggagtgtggtggtgcgatctctgctcactgcaacctccacctcctgggttcaagcgattttcgtgtctcagcctcctgaatagctgggattacaggtgcccgtttagtagagatggagttttcatcatgttgacaggctgctcttgaactcctgaccttaggtggtctgccggccttggcctccgaaagagctggcattacaggcgtgagccaccgtgcccagcctaaaataacttttcttggctgggtacagtggctcgcacctataatcacagcacttcgggagaccgagctgggaggatctcttgagcctaggggttttagaccagcctgggcaacataacgagaccccatctctacaaaggaaatttaaaaattagtagggcgtgatggtgtgtgcctgtagccccagctacttgggaggctgagacgggaggattgcctgagcctgagagatcaagactgcagtgagctgagattgcactgctgcactccagcctgggcaacagagcgagacgctgtctcaaaacagaaacatctctgctttgggccttccttgttggcctctccccagccatgtggccactcgctggcaggcccgggccatgagcatcggtgcggatgctgtgctcagcctgggggcggcgccgtctcctctgggtgggattcgaggcctgatgcctctgcctggtgcaggagggatgttgtgctgagggtgttccccgtgctttggatgtaaaatttgggcatggagtttgtggtgtcttcagaggcagtcccgcctgcgtcctttgtgcatgcctgtccacgccggtcgcagcggtctccccacagagcccgcgcccacgccctggcacagcctctcctgctgtgcacgtcccaggcctttgatggcgtccacgtgctccgccgcctgcctccgagggtggccggggcgctgagtaactcgggaggtttggcccgtgtctggcgtagtgattcattgaagctcagagcctccaggggaaactccacactccctctcaccggagccctggcggggcaggccgggccgagacggtgggagggagggaggccgggagggaaaaacacaaaccctcagagacgctggaaactctgaggttggggccacctccgaatgggttcacatttttcctctgtgtgtcatcacatcctggaaaattactgtcaagaaaaggagacctctgggcagtgtcccggcctgtgtgcatgcccctggcgccctcaccctgcagcccccagcctccctcccctcggtttcccagctcagcggcccagggatgccccagcactgtctgctgtgaggccgcgcgcccgcagggctgcccccggcatcccggacagcgtccctgtccttagtcctgcccgtcctttctggcctttctccggcccccttccagtttcggggcatctggataaatggttagcatcattgtggtccggtccttggcggccctcctggaggccgggacctgggggtccaccgggggcctgggtttgcaggagacaggaaggggctaaaggggcagaagcatgcaggggcttcacctgcaggaggagtcgggtctttcacagctgcccggccaccctcggagcctgagaggccatcacacctttccctcatggtgccagctggaccctccacgctccttgcctccttgtgtgtcatgtggcagccacaggcacccccaccctgtggcgcattttgagcttctggggagctcagcacacacagcccctgtgaaagtgcagtgccggctgctggaccctgctgtgcccccggcatcacccctgtcctctgagacctctgactctgcccagcaagaggggcagggtcgggaagaagggagtgtggggcctttggaagccgggcccaggcagtgaggcggaaaccaggctgggctcagcatggcgagctcctcctggtgaaggcactggtgtccgggggcatcagcggcacagagaaggttctgggctccatctcctgaacctgtctggaagagcccagctgctcccatggacctgcgacctgctgcccggggccgggggtctgggcctctttgcatcggctcaggggaggccatccgtggctgggcgagggtcagctgccatttggatgccccggcagccgtggggctctcgcctctgccagagcaggcagcttccgaggtggcaagggctttggggagcagcgggaggcctgggggtgccgagtgttccggaaatattgctggttcttctggggcagtcctggcccgctgggcagagcagaacacggcctctgctcagtggcagggtggggcgccggggtggcggaaacatgaggccgcgtgaagtgggcatcagttgggccctggggtttggtctcggaggcctgcggggcagtggtcccccggctcttgctgccctgcggttcagttcctcctgctgcagcgcctgtgtgccccgtgggtcggcaggtctcgtgagaggcctcatctgagacaggaagccccacgcaggcttctggaaggctcctcctggctctcagccaccccgttggctgagtgagactgaccccagcagcttcctgaggcgtggcaaggcccccagggacacctggcggccacacacctgggggaccccaccaaggctgagacccaggttggggccccctgcactgctgaggtttgggcctcattccccgctggccctccgtctgcttgggagctttccaggtggggatgtttgtagggacagtggtatggcatccagttgcctcctccctgaaaccttcaacccgaacctcactcagcacagagaattgggggccagaccacggcggacggaggcgtcctgctgacacagcccctgtcgggatgtgggaaggggcggaggcacagctccagccccagcgtgaccgtgtgtgtgggaaaaccgtccgggtacttggggacagcagggacatttccagtgtgggtgtgtgagagccacctcccccatgcggtgggccctggtgtgatgctggcagctgggacaagagtccttctctcagcagatgctgctgtgctcctggggcacagtctgtggttttcttttgtgtgcatgtccatgcttgggtgttgtgtgcatgtccttgcgtgtgcgtgtccttgcgtgtgcacgtgtgtgcttgggggcgtgtgtgtgtccttgcgggtacacatgcgtgcttggggtgtgtgtgcatgtccttgtgggtgcacgtgtgtgcacgggtgtgtgtgtgtgcgtccttgcatgtgcacaggtgtgtgtgtgtgtgtgtgtccttgcgggtgcatgtgcatgcttggggggcgtgtgcgtgtccttgcgggtgcacgtgcgtgtttgggggtgtgtgtgtgtccttgcgggtgcacgtgtgcttgggtgcatgcaggtgtgtgtgtatatgcatgtctgtgtgtgcacatatgtgcatgcatgtttgccccagagcggaaggaaagtgaatgcagccgaatgatcacatctgcatgaggggtgttcactgttgtgtctgcccatctttctgtgggctgaaatatttcaaaataagaaattgaggggaaagagaaaggagggtgcttgtctctctccttgcctcctgctcctcctccctgtgttggaggctccaggacgcctcacccccggttgacgtcatttttggcctgcacaggcagcccgtttcttttctcctggcaccggcgaggaggctggggaggggggacgggaattcccccaggggccaggccttgactgccctgcagggccctcgctgtcgcttttttccctcacagtgtctcatccctcaacctctgttttccatccaaaggcatctctgtgaatccacctggcgcgggagcggcgctgatgccacaaatgcgggccagactgctgggcagagctcaccagtcaacagggctgggtgtggctggggcagccctgagaccccaggccctgccgctgtggctcccccttcctggcccctcttctctgtgggacagaaagtctctcctggggaaggctcggagctgagctgatgggtgtttgaagtttctccacacacagggtcccctggcatctccctctgtcatttggtggccaagtgacatttcccagcagccctactgcagacgccatatgttctcggggtgactcaggtggcctgggcccttctggtagccgcttatccagcctgaccccaggctccagcgaggctgctccggatcggggctgctctgcccaggtgaagggcgggtgtgggaggtttccgtagaggccgctctcccctgctaccacggccccgtgtgggaccctgggtctgtctgacagacagaggcttcctgagccaggcccttgggatgacgggtaggaatctagggtggatccacaggaattagagattttttcagttttgttttccaaatgaagtcaacagccccctagcagcgtgatgctgatggtcctgtcccctatggcccccatcctggaggcaccctggtgtgggctgtgggcctgggggtccttggcactgtccagtatgcggacgtggcagcagcccacatttcccccagtgaccaccaggctgtgccctggacgtggccgcctgagcacggcatgtcctggggccccgtctggtggtcaggctcagtacgagcccatcaggggtactctgcccgcctgggaagacagtgtggcttctgggggctcctccagggaggctctggaccaggctgcagaggatgccaacctgccacaggctggcctggccgctcatggacatggcggctcctggcccagggtctctcccccgggaacccaggcgtgctcgcggccctctggaatgcaggcgctggggctgtggggggccgcctggcgcctggcatcttgttataaaaagctctggcgcaggctgctctcagtggctgcaggatggttgtggctttggaagggcagcccccaggggccttggtcagccacctgtgggccccactgccgagccgtggtcagccctcactggctgccctgccatgacgctgctgaggtcagtgcagctcccgccagactcccgtgacaagtcataacagagccacatgctgggtggctgcagggccctgtcgcccacagcagtcgaggtctcaggtgtgtccggagggcagccctggagacacctgggacaggcgtacctctggcaggcgcaccctggctgtcacccagtgtgggcatggtgggggtgctggaatgctgtgtagggcaggaggcagcagcccgtggctgggtgggagactgcagggtagacgggacgggaccaggagggttgttcgcagggactgccaagccatccccaggtgtcgagagtgtgaggtaggagtgggagcccagagccggctccaggccaccccaactcccgacagctctcggctgttctgtgtgaggggggacggggccgagtgtgggtcggcgcagtgctgaggtgtcccacgtaccccagcactgtgctgaatgcattgaaatcactgcccagggctccgcgagctgcacggcccggctttgtcaatttcattgctgttgatgccaattaggggtgacgctgtccctcccgcatcccagggtgggcagagggaggggccggcttgttccctgggggcaggcgtgcatggattcagcctggccatggagctgtggccaagagggcagcgggggcagctggactggggtttttgccgacgctctaatttggcggctgtcgccacccctcccccccatggagaccctgacgtggcctgagccagactccaggggccatgtgccctgctggggagcaggggctcagcatcaggtctggtgcactgactgggagaggggggtctccagccctggacaggctctgagtggggtggggtcccccagctgctgtgcccagccctgcccccaggacctggccttggccctgcgctggccggggccagggagggagtgggcccagctcccaagtctgtgtgaccacctcggctggggcactgacagcccggggtgcggagggcccagcccgtgacacccgccgtcagccgcgccctctgcctccagcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggtgggtgccccctcagtgcctcccggcatcttcgcgccagggtttgccccatcgggtgcttgtgctgcccgctgtccccagtgccagcactggctcccggcccaggtccctgacaggctgcccttaacaggacctcagagggttggggcccagggaggggcgtccagaccttcctgccttgtgtggggagagcagcccactcccaccctggagggtgcaggtgaggagcccggggcctgttgccagggcccccattctgaccagaagccctgttccttcccctcctcaccacaggaagcgcctggaagaagcccccttggtgaccaaggccttcagggaggcgcagataaaggagaagctggagcgctacccaaaggtctgcagacaggatgtgggggcgactgaggcacagctctgagggggccccccgtgaggtctgtggacgggatggggcgactgaggcacagctctgagcgggccccctgtgaggtctgtggacaggacgtggtggcgactgaggcacagctctgagcgggccccctgtgaggtctgtggatgggacgtgggggcgactgaggtacagctctgagggggccccctgtgaggtctgtggatgggacgtgggggcgactgaggcacagctctgagcagggcccccccgtggtggcgcgcatgcccttagtggccagttgatcctcccctgctcatgatttagaatgaaacctttttttttttttgagacggagtctctctctgtcgcccaggctggagtcagtggtgccatctcagctcactgcaagctccgcctcccgggttcaagtggttctcctgcctcagcctcccaagtagctgggatttcaggtacccgctaccactagctcggctaatttttgttgttttttttttttttactagagatggagttttaccatgttggcccggctggtctcgaactcctgacctcaggtgatctgcccgcctcggcctcccaaagttctgggattacaggcttgagccaccacacctggctgaatgaaactttaaacagcacatttgagccgggcgtggtggctcacgcctgtaatcccagcactttgggaggccaaggtgggcggatcatgaggtcaggagatcgagaccatcctggctgacacggtgaaaccccatctctactaaaaatacaaaaaattagtcaggagaggtggcgcacgcctgtagtcccagctgctcgggaggctgaggcaggagaaaggcgtgaacccgggaggtggagcttacagtgagccgagatcatgccactgcactccagcctgggcgacagagtgagactccatctcaaaaaaaaaaaaaaaaaaaaaaaaccagcacatttgaacccaggtcagtgtggttttagaacgcaggccgctgtgcacacacacggcacttggctgtctccatgcccagcctgccacgggggagtcaaagcccaggccctgattgggggtggctgcttctgcctgcctcagccctggtgtccatggcccagcatgggccgagtggggaggccacgccctggtccctggtgcagctccggccgtccctccaacccttccacttgtctggcctaggtggctctgagggtcctgttccccgaccgctacgtcctacagggcttcttccgccccagcgagacaggtgggcagcgctgtggggtgtccggggatggggggcaggggcccatggggcctctcccggctccttccttccaggccacaggactgcagccacctggcctgcgggctccagggcactgggtgggtgcgggtgctgatgtccccttgggggtgcagaggcatcccagttcgcagagtgtcaggcaggctgggcgcttgctccaggtgcccggccccagctcagggagcccgtggtcctgagtgctcacgtcgcccacctactgggcatgggtggggcagaggggcacccagaggaaggcaccctaccccgggaggagggcagtggtgctgtgacattcaggggcttgtgacctgtacccagacggccgggcggcagcagcccaaggtcacaggggcctcccccagggaaagggaagcgcttaggctggggcgggggtggggctggggggcagcgggtggcagtgggagtgctctccagcagggcgggggtcccaagtgtggcccgcacggtggcccagccacgccgagcacctggagtgctgtgggaggaacagggctgaattcccacccctcggggaaaggcccaggagggtgggagcagtggcccaggtgctggggcagcccggggctggcgtggtggaagagctgtctgtatgttctttttctcctctgcagtgggggacttgcgagacttcgtgaggagccacctggggaaccccgagctgtcattttacctgtgtacgttttttctcctgagcccactcctgcctccagtgctcggggccttggtgctgtgggcacaccgcccgtcccagctggggctcgtggcagcttctccacaggagcagcatctgtggcctcccgcccaggtgcctcctgcagcccatggtgtctgtgtggagacctaggagggcccttctccccgagccaggcggtgggagccaggcttcctgccttctctctcagcgccctgctcccctctggagccctgctgcaccccagcctggtccccacccctggggctcaggccactcctgcccgagggctgtgggaagggtgggtggacagggagtggctggcctcccttggagggtgtctaggtggcaaagggttaggctgcccactgcaaggggagccgggctgcacgggtggtgtcccctgcaggtgggcctgccccccaccggcccttccgagccctcagctggagtttctgcagcaggagtgtgggcacagggcgtgctcgtgaggggctcttctgccccacttgaggcgtcacccccatctgcaggcctgtcttccttcgggcgcatggatgggcgaggtccacggtgcttcctaacacgtaggtgccttctctcctcagtcatcacccctccaaaaacagtcctggacgaccacacgcagaccctctttcaggtacctgagggcctccctggggtgctgcggggcggggccctccagggagggcaggacgagagcgtgaggcctcgggcaggaaggaggggcctggcaggcgctggggcaggataataaagcctttgagagccggtgggttccgagggggccgtgcgcctctgaagttgcttctgacacggctttccggcctcctctgcttcctgcctggccccgggtgggaaaggacctgctaggcggcctgcctgaactgaggccgcttggaggtctcggcccccctgggctgctgtgctggggccaaggcggcagcagtccctgcccaggggtctgggtgaggaagggcccggcaggcctcggagcagggctcagggagccccagagggaccaggccctcagctggaggcggccgccttgggcttcagctgccccttccccctgcccggcctctcccgctggccccccggtccctgctaggaacgccctggtgcccatagctgtccgctgcttctgtgggtccctgccacctccctgagggctcctgagggtggggccagggtgagggtgccgggttcccagccctgctgggccgccctccagagccagaagcaatgaatgtcctgtccttggcctgtgggagagctgcctggggccttccgaagccctctggcctaatggtttcctcttcaaagcctcttcagatattttaattagccacagaggcgggtttttttttaagtggccacaggcctctacagaggcctgggttggaggtgagaagcttgctcactgcctggggctgcagccgcttactgagctggggcaagaaggctggcagctgccaggggtgatcaggagcaggactgagcgggattccctgcagcggaggcaggggaggggtgagacagtcccctctcagcccccgagctgccgggcggactccgggcctccttcctccgtctccatcccctcccttgctggccagccagttgataaacattgaatttggaagatgccttgggatggaggaggaccagtgcccaggcctgcagcccaccctcccgctgggaggcccctgagagcactggggtgctgctgccctgtttctggggacgcttggcttccctaccagccaccgtctcctgccctccatcagctcggctctagcctcggggcctctcggggtggtgtccccggtgacgtgcctgcctgcctgcctgccgtcagagagctggcggggctgagggaaggaagcctgcctccctggcaggcaagcaggcggcgggcgcggaagcaccagctttcacgtctctggcagagccccactccggctgcctgctgcctgggggatgtccaggggccggcccccggcttccgagagggacagcgtgcgtgggtgtgggggctccggtagcccggcagccctctgtggccctggcccaggagagtgcaggttttctgggagggctgggaggaggcggccaggagtgaggacagggaattgtgagcagtgtgggggcaccactgtggggaacaaagccccccgcccctgcctgaaacctgcgtcctggccctgggcatcagggctggccctgccctggtgtcctcacacagtcacttctgtgtgcggtccgcgtcctcaggtcatgaggaaggtcaccctgggctaggcccacctttgatgtcacggtcacctcacttatctcttcaaaggctctgctgtttgggcttccttccattggctttggcagggcaagcctggctcctaacaccctccgtttgttggagctctcaggctgcctctggggaccgtctgccaggacacaggccacccttgctgcctggttccccactccccaagccactcacctggcagggcgtgactggcacttctggcctgagtgcctgctgggcgcccgcccctagccagttctgtcgtccttcctttccacccaggacagccccgtcctgcactgccgtgtcgcccactgccggggcctctctgggaccaacaggcccccttccttccacccaccaggccctaccccacctggaccctctgaaatgttcctcgttgacaaatggtcttgcagaaggcaggatggctcctgcagcccccactcccgctctgtgggtggatgccccgtctctccctgcccaggcaccgtggtgccttctctctcccgggcaccgtggtgccacctccctcccagacaccatgatgctgcctccctcccgggctctgtggtgccatctccctgccgaggcactgtggtgccgccttcctcccgggcacggtggtgccgcctccctcccaggcgctgtggtgccgcctccctcccgggcgtcttgagctgcaagggctcctctcttggcttcgttccccggagggtggtgctgttctcgttggagggggcggccaggcgctgggccacgtgtgcatgcagcccctacagagttgctgccccgtgggggttgacgtgggcctcctttcggaagctcttcctggcaacactgagtggggcaaggggttggcagcagagaggcggctggatttggggccccagtgtcctgggcggcagctagggaggggccggctccaggccctcaggctgtgtcagggcagggcgggcacccccacttctccctgtcagccgagggagccaggcaggggcagcctgagacatcctgggacagtgctggtggggagaggcccctcagcctgtgcctccctcaaaggcccttcccgggccctgctctggctggggggacggtgtgacccactttccctttccagccccagcttggtgaccgggtggctccattcaccctgggtccctcgctgaaacggtgcctgggaccagagcagagaacacgcttgccagtggtaggagatggaggcgacgtggactctgggaggcttcttttttggggtccatccagaggccgagcctctccaagcactggtcagcctccatgccacccagtctgccgaccctcctctccaccatcccctcgtccgagcagtggcgatccctcccgagtcaaggctgggcacaagcacgtggggacaggccgggtaggctgcctggctcagtgctccctgcacagaggcgcagacagggagcccaggtgccccaggcctggctgccaagcctacttccctctcctggtgttcccgagtcctgcccgcccctttctgtgcgtcccgtggggcagtgctggttgggggtcctggcctgtgggggctatgatgagaaccaggtgcctctctgcatcggtggcctctgagggagccctctcgcccggcagcaggtgggatgcagatggggctggccagggctcctgtgcccacagcagcctctgggcagtgtaccctgggcttctgtgagcagccgcagcctgggtgtgaatcttggaggcccggtggtggcggagcatgctctccatctgggagaggctgagaccatggcagctcctggcgctgtcctccccgtgcccccttcctggctccccagcttccggcgcctctccagggccactcgggcagcccctgcccaccccacaggcccttctctgctcacaaggctttgatcccaggcggcacaattgggttttcaaagcattcacggcccttgtttgtgtccctgggcccccggctggaggctgaggtttcggcgttcctgggcctggcctttgaagcttcctcttattaatcttttaacatcccccagccccactcccacccccagcctgtggccctgagcagcctggagccgggagggggaatctggagctgggagggggataccccagcctggcagctgcacccctccacggtggtcccggcgcatccgccaggacccgccacgcctggccccaccttcctcgggtgcagaggccagaggagggaggacggtgatgctgcatggcttgaggaccctcgaggccccagccttcagctggcttggggcttggggtggtcccatggagggcgctggtcccaggacgccctggccttgcttacaggggtagggctggtgtcagacaggaagctgggcgatgggctcatgggggccgggcaggcagagcctgtctgagggtggagctggggcctggccctgggggtgtagctgccttcacagcaggggggtgctctgcccacacccggcccctgagccccccgccctccctgcaggcgaacctcttcccggccgctctggtgcacttgggagccgaggagccggcaggtgagtgtcagtggttggggccagtgtcggagtccagccagcctgtccctggacctcagagccagctgcccgggagggcgttcggtctggggcctcctttgggtctgagagggagatctgcggcccccagtaaccacctccccgagagaggactgggacagccacctgctggccacccccctcccagagctgagtgctggtgggcagatgctgggtggatggtgagtggacccctcctcagaggctcagggtgagcttgggcctccctgcaggtgtctacctggagcctggcctgctggagcatgccatctccccatctgcggccgatgtgctggtggccaggtaagtgccggtgggtctgggggcacctcccgtggcggcactcaccactctgtgtcttcgcctccccacaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccgggtactgcggctgggtggaaggtggggtgctgtggccgggtggagggcgggggtccgggtgctgtggcagggtcagtgggctggggggctaggtgctgtggccggcagggccgagtgcttcagccgggctggtgggcgggtggccgggtggtgagagcccggggtgtgtggtcaccctgatgtgtctgcactacagccagcaagaggtgagagctgccagcctgaggtgcccactccgccagccacaggaccacctcctctgccagcaggaataaagacttgtgcatccctcaacgccttcctgtcatgcttcctccagaaaagggcccccgtcgtctgccctggctcagctggaccgcagtgtccaggcctgagagcctggtggaccatggtgtgggcccctgaggagcctggtggaccgtggtgtgcatcctgaacccgcgtgggtctcctcttcgtttttaacctaacagttatttacacttcctccaaggagaacagaagtgcttgaggaaagtcttttgggggaaatcacctgcaacccaggagccaagccctgggccaggagctgggggaggagctagtaggtcaccccacatccgtagggcagggcctggcctcaggcctcctgctgcccccgagcgggctatagtgctgggttctggccctggtccaccctgcagccagcctccccagcaagtctgatgacttctacaggctcccagggctttcaaactgacctactgaggtgggcagggcggggaaggggtggatcccagcagccctgcctgcccggggccactggggctacatcgaggatgaagaggctcgcctcaaagttgtcttcgggcaccagggcaggagagaggctgggtcgcctccgatggttcccaggggcagcttttgtgcttcccaccctggggcctgactccctaccctttcccctccctgcacggggctccaggatggcgctcagctgagagcccctggggtgcttccagtcctgggctctgacaagagagagaacgtgaggtgggctggaggggaagtggtccaaggccctgcccgcttcccaagcgttggcacaagtggggcttatgccagaggcccctgagagtcagagggcagccagacctgggtggggcatccagacaggtcccacagccctgcgtctccaagggtgggcagggggcgtggcccgagggggctgacctgcacctctctggcactgcttgggaaaagaggaggccttcatttcagcagggccttgggccagggtccctctcaccctgtgcatcctggtcctgcctgtgaccacaggaacattcgtggaagccactgcccactggtggcagcccccgtggctgccccaacccctggggtaggaataacatttcccaggcaggtggccacatgtacgtggtccgggctccacagcgcctgggggtggggccgaggcactcgcacacatgctgtttgttagtgcatcctcctggcgctttgctttcttaccaggagtggaagggcacacacgggaagtgcagctttgaagcagtttgactttggtgattaatggcaagaaagccaagctgggagagacagttttgatttattgatgttgctttgtgagaacaaatttatagcctggggaagcatcttccaaggggaatatcgcatggctggaaaggtcacacgccagctttgatgtcgggtggcaggaatgtgggcaggaggcagcgctgccagctgctgtttgtcaaacacacaggctacctgctggccaggcctttcccagcacctgcctgtaggaccccgggtggcatgcacactattgtcccagggaggagaggcagggactccccaggtgctgccccttcccacaccagtgtccccactggacactccaaggcccgcagtgcactgcagtcctgccccttctgcacaggctggagactcccagagatcttgtttgaatcaactccaaatccttcaggtccttccctgcctcttatcagaggccgctggaaacacaaggcctgcttctgtggaccaggggctcctctgggggtggcctcagccacggctgagatccctagaagtccaggagctgtggggaagagaagcacttagggccagccagccgggcacccccacttgcgccccgacccacgctcacgcaccagctgcggaagcaccttctccagctggtccacgtccacacggagcgcgtcttctgcctgggcctgccgcacgccgcggactgctgcttctgcggtgagaaacgcgagaggtgggggatgctggggggatcttaaacccgagcccagtgagggcctcagcctgggccggtgccccccccaacacccacgggcagcccccagaaccaggccacagcacctgacaaacaggctcaggagacccaagtttaggcccttgtgggaaacgggaaaacacgtcttggttttcccgctggaaaaacgcaaaattccggatgctgtgcccggagggagcgtgggccctgggctcacccacaacgaagaccttcagcaactccaccatgagctgcagcgcgtccccgctcactgcaaggcagggggaggttatgcgggaccctcacccaccgctctggctgggtgctccagacatacccccgccctcccgaggccttggccctgcagagttgcaggaaagggtccctgaggacagacacggggacccacctcccgcccgcacccccacccgcacctttggtcttgtcatccttgaagtgcaggtgcagcagcctgctcaccagctcctagaagggaggggggtgtcagcgccacgccccgccctcccccccgcaccccccagggtggtgaccattctggtgacagtggctgtgacttctggctggagacgccctctgtgcctgagcctctcccagggcaggggacaagggccagcctagtgcttcgggtggcagaagctgaagcagatgcgtgggcagctccactagggggcgccagggccctgcacagggtctgggctgggagcctccctacggcgtgagtggtcgcagacacgggagcaggccccgctgctggggctccagggagagagtggagaaaggcctcgtcgagtccggcctaatcttgcactcccatccccggcagagggccatggctctgctctccttgtggggaggcagggaaggcagagcccgggttgggtctggaggctggaggtggctgctctgcaggtgggctggcctgagggagtgccaccagtagggccttccttgtgccaactctgttctgggtgctgggtcagctccgcccgtcttgccctggtgctcatgatcctgcaggaggtgctggtgtcctgggagcgcagagcggggctgcgccagcgtggtccacaggctggagtgaggggtgggccagacgctgagggcccagggcatgatgagctctccgtgtctccatggcaggaaactgggagtcctctctaggtttttgtggaaagcagcactggcgttggaaaggaccactctggctgccatgcccggggtggggggaagggagggggctgcagagccagggcctttctgcctttctgatggatggaggacggggacaagggaggagtctacgccaagaccccaaaaggacggcactgctctgaggagatggggggccgtgggcaagtgcattttggagctaggacacaggagatcagtttgggatgcgttgtgtgtgaacacaggagtggtgggtggcagctgcagtggtggcggccgagactcaggagggcagccctgggtggctggtggagccatgagactcagtgaggtggcccaggccaggcaccggcccacagccgccgggaaaggagccagcacggagagtccaggactgggggtgggggcagtgggcacccaggagcccagaaacaggccactaaaagggcaggtgggtgaactaccagccaggccaccagcatcggccacagggaggtcacagcacctcacccagagcagtccagcaggtgacaagcagagcatggacgggtgaagccctaagatgcagatggtgaagaatgttccccagcagcgggcagcagggtccagcatcccggcttgtccagcatcccggctcgtcctgagcccttgctgttccctagccagggtcccagtcaccacccgcatgagcccagtgccacctgctggtccttccagctgcttactgccagcagtaccagaaaggcaccagaaaaggtagagaaggcactatctccccacctgctccgggacccccaacactgctgccccaggccttggaaggaagaccacgccagagagtggcggatgccaggtctgcctcgacaatccatggggcttccccgtacatcggcagtggcctcggaaggcaggcccagcactggggcggttgtggagggtgcctaggacacagccagctttgccccatgacgtgggcgccacgccagggctacgggccccccactccccgtcattctcacgctcattctctgcaatgaccacaactccagctctggccagagcccctgggcctctagttgtcaggtgggcttgatagaacacatgacctcctggggtgtgtacccagtgccccgtctccggcagtggccttttggctactttaacctggtgttctcacaaccacccagtgaggtggcccaagcctcagtgactttctctttctgaattccggcaagaatcttcaactccaccaccagagttccccacaccgacaccccccgccccccacgcctgctgccttgggtgataaagaagggcctgattcaggagaaacagaattctccctgcttctacagggctgaagtcctccctccaggatgggttcacaagggcctgagaccctcccttcccaggccacagaggcccacgaggccctgctgacatcgaggaagctcggtgccccaaccttcaggtagagcagtagaaaggttcagaaaccactctgcctgcaccgatggggtcctctgcacatggcacccccagagagctccacttccaggaacagggaagagcagggcacgccctccagcctgggcggatcctggctcagacggcctaggtctgaccctagccctgctgagtcacttaacgcccccgtgcctcagtttctccactggcaggtggggttaatccctgtcaagtgtgtgtaacgtggagcaccgaagaaaccacgcgttcctagcccagtgctggcgcccaccggggagcaaacaaaagggaaaccactgtgcctggcggctggggtaggtcctgccggctcctcgggctggacgatctcactgtccccgtcctggggcctcatctccccttaacaaaagaccccaggctcagggcgcagggcggcggcccagctcctcctctctcttcgccggcttggactccgccgtgacggcgcccacccctgcctgtttctgcagaccctctccaccttcccgcagccccggctgctccacgccccctcctaccagctgcgagacaccagcccacgagggcgcggggcgcgcggcccggccggagatggagtctgagaacgggcccaacctcaaaggcacagggggcggcgcgggggctggcgtctggccctcacagtgtcacgcgtgaggtcgggacggagcgtccgcgcctgcctagcccctgccctccggccctcaccttccggaagccggatccagctcctgctccctccatgaccgcagcctcaacgcgcgcccaccggaaccccgccccgcgcctccagccaatgagaccggagcgcgcccccggagccccgccccgcgcccctagccaatgagtccgaagcgcctgctctcggagccccgcccccacgtctcagccaatgagcccggagcgcgccctccagcagcccctccctcacgtcccgcagccaatgaacttggaacgcgccctcccggggcaccaccctcacgaccctcagccaatgagcccggagcatgccctcccggggccccaccctcatgcccctagccaatgaacctggagcgcgctgccccctctcagcttgcggcccgaaaggcgcgccagttcctttgttctcattggcccgcaccaagcgctgcctgcgcagagcctgctaggagttgtagttcccgcggcctctcccggcgcgccttgttcttcctggatactgaggccccgacgcggctgtcgcgagggcgggggtcggggctgcaggcggggcagggctgggtgggggcgcgcgacgcacctgcctgcttcctgcacgggtggtccccaagcactgcggggccccagcccaaagcggaccttgactaccgcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaaggtgggcaggcgcggcggggtggatccctctgctccttagctgcccacaccattgcctcggcagcccgaggtcgcttcctctccaggctctccaatttctgtgccgtagttaaagcgagcaggggcgccccttcctgcacctgggagtagagggcagttcctctgtatgacgggggagaggccttaacattcgcggtcttacctggttccccgcgtgcagagccggcttggtgcctggcaggggctgcaggtgtttcaaacatgacttcgcagcgagactcttggccagcgccaacccagaccatcgggacagttgtcccttcctgggtctagggagctgccctgaaaaggggcccacggggagggccttggggtcagcaggggcagagagtgaccgccggccccccttacacaggggccacactgctgctccgaggcctgtgtgccaacaccgtgctgcgctttctggacttaaaggtgagatacctgcactcttgagtgtccgagtgtgccacccaagggcaagaggagaggtggaagatgccaggtctcgggggcctggggtctgggcaggtggctggaagctgtctgtgagtccccaggccgctctctgatggcctcctgtgtgtgaccatctccagagcaagagttcacattggcaaacaagccggcccttggaagccccctgaagacagggagcccaggagctgaggaaggctgcagggtgcaccccaggcttgtcccctggctgaccaaggcccttggggcatgggcgggaattcagagccagtcagggcacgcgagtgactaccggcctgtttctctcctagggcaacaaccttcgggctgcaggggccgaggctctgggaaaactcctccaacagaacaagtccattcagaggtgggtggtggtcccgaccccaggccctgtctctgtgtggttgaggattggccccgagcacatgcttctgcagcccaagagttccccattgccaggtgcccatgtttcacatacgttggcaggggtaggcagaggctccggcccatcagaccccaagcccacacccgtccccaagccctggaccccacgggctaggcagtcccctaggtgaacactggcttctgcccctcctgcagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctgggtgaggcctcccaggcgccctcaggctccctcatccctctgaggctgcctctgctctgggaagtgaggggctaggggactggcctgtgctcctgctctgttgatgactgcaaggcagtgccccctagggaagcaccccggccaggccagctccccctctgccaggtgcattctgtctggtgactacaggtttccttccagacctgcgctggaataacgttggcctcctggggggccgggccctcatgaactgtctccccagcaacagaaccctgtggagactggacctggctgggaacaacatccctggagacgtcctcagagccgtgggtacggtgcagggctgtgtggagtgacgcgtgagcctttgacagaggcctgtccaccgagggcggggtgccgggctcaggacgggaactgatgaggagagcagcctgagagcccaggggaagcaggaaggagcggaggggtcgtggggcacctgtttggcacttgaatggcgttcgccacacatgggcactgtccgaggcgccctgtgtacttgctgagttcttaggacctgtgcagtggagggtgcccgtttcacagctggggaagctgaggccgtgtggctcacagtcctggccttggtggctttgctgatgcttcgggtggcccaggtcttggccttggccaggaaggctccctggtcaccctgagtctgtggccctgcatgtgagtcaggtgaggtggggccccctggcttgtgctggcctccacacattccctcccaccagcgaccccgaatccttgcagctgatgtctcagcctcaggccccagtgccccagactcagctggggactttgccaggccccccgtactccctaatccgcgcacagcggcagcctcttccagcccctgtgctgagggctcatccctcctgctggttctgcctggcctctgactccagctgcgccgtccctggcttcgcctcggcactgccctggttgttgtcatccctcctgacctctgccccctcgccacatgctacccagatctttccagaactgagctgggcacagcatttgcctcagcattgtgcagtgccccttgacctttgggatggtggccagatgccccaggatggcccttgccttttgcggtggagcagctcccaccacctctgccccacatgtgcacgcgctccccaacaccaggcggctcttgctcacagcccgaaccccacaaagcacttccacccccatgcactgagggggcacccctgacttgccgggtgagacgctgccccacacggcatagattcccaagcagccagccgctgggtgcagggctggtggccaccagctactcctgaggctaagcagccccggggtgacacagctcctttgtgtgtgtgtgtgtgtgtgtgtgtgtgtgtgtgtgactgagtttcactcagtcacccaggctggagtgcagtggcgcaatctcggctcactgcaacctccacctcccggttcaagcgattttcctgcctcagcctcccgagtacctgggattacaggtgtgcgctaccatgcccagctacttttttgtatttttagtacagatggggtttcaccatgttggccaggctggtctcgaacccctgacctcaggtgatccacccacctcgacctcccaaagtgctgggattccaggcatgagcccctgtgcccagctgacacagctccttctgcagagcaagccatgggccacagccaggaccggctcaccaccttccaggagaaccaagcccgcactcacgtcctcagcaaggaggtccagcacctccgggaggagaagtccaagcaggtgaggatggcgccttcactgaccttggagctgcttatggctggagggcctggccacgtccttcctccctcagccccgtggtctgcccatcttcccttcctcggggccctggagcctctctgagtggctggtaccaggaaggaggggcggcctcctggtctgatctgcaggtggacttccttggggagctggcgtctgagccctgaggcctcgctctgcaggggccacccttcctgtgaaggagacagggcaccgtgggtggaaccctccgctgccttgccacattggtgggcgctggctctccttccccctgagaaggtcaggtggacaggctgcaggtgccctgacagggctgcggctgtctctgtccccagttcctcgacttgatggagactattgataagcagcgagaagagatggccaagagcagcaggtgagcgggcccagggcaggggcagggtgaggcttcagggatcaggtcctggctcagactcagatgggaccaacctgagcccacgagtgaggccacgaggaggtcgctggaggctcagtgcccaggcgaccatagatgcttaaggaacagcagcagctaccgaggccagaggggtatgggagcgctctggggtttgggttactctctgcaccctcctctctgcccacagggcgtcggcagcccgtgtagggcagcttcaggaagccctgaatgagaggcactccatcatcaacgctctcaaggccaagtaagtggggggtggcctcaggatacttcagagacgtgcccacagggcagagaaaggtggtgtgaacctgtgtgcaagtcctgtttgcaaagcagaggtgggaaatggtgaggctggggcagtaacccagaagccttcctggaggaggcgggtgctggctggggttgactaggtgcccagcaacagtgaaagcagcgaggcctttataaggcaagtgaaactccaaccggggcgggggtgctgcccctcctttctgcaggctgcagatgacagaggccgccctggctctgtcggagcagaaggcccaggacctgggggagctcctggccacagcggagcaggagcagctgagcctgtcacagaggcaggccaaggagctcaagctggagcagcaggtgggtgggcagggcttgagaggggtgggccaaggggtgcgtggcggcttcgtgaccctcactacccataccccgttcccctcccaggaagctgcagagcgggagtctaaactcctcagagacttgtctgctgccaatgaaaagaacctgcttctgcaaaaccaggtagctgtggtggatggagccagggagcccagggtgggcgcggcagggctgggctgcagcttccctccctggtgccggctttcaggtagacgagttggagcggaagttcaggtgtcagcaggagcagctgttccagaccaggcaggagatgaccagcatgtcagctgagctgaagatgcgggccatccaggccgagggtgggcacgggcaggcctgctgtggaggggcctggggatgggcaccgggggacgggggcccccaggggatgctcacgcatactctgcccaccctgggcttccagagcgcctggacatggagaagagaagatgcagacagagcctggaggactccgaaagcctgcgcatcaaggaggtgccctcttcgttggcctctaatgcgcctcagtctctggtcttggtgtcacgcaggtgtccccaaagcacacacctggtgggagcttcccttgccaaccttgggtcactgggtggccgtattttgccagcctgagcggatgtcagacccagaacctcctattgggggcggcggggggaccccggcaatgtctgagccgtagtacaggctgccgttgaagagacaccaaggcccactcgttcagggtgtgcatgctgcggtagtttcctgctaggccatctgaggcagtgctttctcagaatgaacaaggttctcaagagacacctgcctttcagggtggggagtccgtgaggagaaggtagggaggcccgctctccactctggccccacaatccctgcccctgagcaggtggagcatatgacccgtcacctggaggagagtgagaaggccatgcaggagcgggtgcagaggctggaggcggcgcggctgtccctggaggaggtgagtgcccaccaggcagggccaagctctgccttagtcctgggctgaacaaggcaggggcccctggtgttcgccgcctcaggaccagagacctcttcctgttcccagaggctcataggccccaccttggggacccacccaccagtgtgcccaagaagctaaagggacttaggtggcattcggacttccttggccttaggaaccttgcccagcgagctaggtggcagagcagctgcgtggccctcaggaggctggcagagaggagcccccctggctggggttggctggatgggccagagagagaagggccctgggccagggacaggagaacgggctggcaggtggccatctgtgcaggagctgagccgagtgaaagcagcggcactcagcgagcgtggccaggctgaggaggagctgatcaaggccaagagccaggcccgcctggaggaggtgagccacacatgtccgccaccctccgggggagccaggctgcccggcattgcggcccgcatgcagactccagagcttcggtctgagtggggaggcgggagtgtggtgttgaggtcagatgagcacaccctggacactggtgggtccgcttcagccttggatcagggcctgagacggtggagaggtttggcccatctctgcagcctgtgactacacgcatggatggatgggaggggtggtgtgaccgaagagggaggaggagagcccagagggcatctggaggaggtggctgccaggggagcgggttcagagtcatagtaactagagcagccagtcctgcagagaggtggggtcgtgcccgtgcagacattccctcagctgagctcaggctgagcccctcatgcttcgtggcggcccctgtgctcacagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggtaggcggggctccggtggggggccccgggcgtgctagcccccaaccctcgcctcactccccagccttcgtgcctggcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaaggtgagccagacccttgtcctcccgccgcccactggtgggacgtgaggccagccagagagcggggctggccaggtctcccgtgctgaggccgtgccacggtgcgctggggctgcgtccgctcactgcgctccttgccctgcagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgatacattctggccccgcctctccctccaaacgcgcgaccgtccgtgcctctccaaacgcgcggccctctgcccccagccctgcagggagggcctgccggggtgcggctgttcgcccctcctcgccgctgccttgaagggacgggagggccgcgggggctgtccgtctgggggttcgggcggctgcagaccccggagttcccagctggctcccggcggcagggggcgggtccccgagaaagcgcagcgcgcggagccctccccgccgggtccaggtcgctgggctctctccggcctgcgctgcgccccgagggacccgtaggagacccccgggccggggtcgcgctggaggcgggggcgccgcagctcgcgcagctctgcccgggttcgggcggccccgccccgccagccgcgcggccgggcgccccccgcccgcccccgcccccgccccccgccccccgccggccgcgctcggctgtctccgcgcccggcgctcggcggcgctcggctgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacgggtgagtgcgcggcccggaggccgcttggctgggctgggcgggaggggggctcgggggctcggggcgcagccggggcggggcgggggtggcgcccgggtcctcgcgaggcggccccgccgtaccccgcccgagccgcgtgcgccccggggtcgaggagggcggggtggggcggggcggggtccgcgggcctccagctcgggcccacctgatgctgcccggctcccgcttgggctggctgcgggcgaggcggggccgccgccctgtcctcccagtgggtggggccaggcctctcacctgggctgaaccctcagccggccccaccctctcctgccgccaccctcggagtcggggcctctgcctggggccccagtgtggggcgccctgcgcccttattcaccaccccagcccccggagcccggcctgcccaggtcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtgtgagtgtggcatgggggggacacgggcagggtctcctctgggcttccacgtcggctcaggtggccctgtctctgggcttcccggctggagctgaggtgctggccagagttctagttctgtgcagacttgtgaaccccaagacacaggccagcagggctgggggtttctgggacccctcccaagccctgaccctgccctcactgctctgcagttttgacaactactctgccaacgtgatggtggacgggaaaccagtcaacttggggctgtgggacacagcgggtcaggaggactacgatcggctgcggccactctcctacccccaaactgtacgtaacaatggggccagccccgggagctgggggggtccctgagatccgcacaagggagggagcagggccctggggagcccctgaccactccaccaggtcccacctttttcccaaggacgtctttctgatctgcttctctctggtgagcccggcctccttcgagaatgttcgtgccaaggtagggcaaggctgggggcccctgtggggagagggcttgccccagtacctgccccgacaagttgtcctttagaggcaattgcgatacgggttctgcctggggtaggcacacggagtggggtctgaagatgaccatgggggctgatggggtgccgtggtggtggtcacagctctcagaatggagggttctgagggctctggctgctggggatgggccttgactaggaggccctgggaggtctccaggttccctggctgcgtgtttgttcctggtatctccccaccaaatccgcccctggtcaccccttgaaggaagaagagccaagtgtagctctggaacagtggggaaagtccctgagggccgtgacttgctcaggtggggctggggtagccgactccgggcctagggatcagagcgtctgtccctgcagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggtgggtaggcgctggcggcctgcaggggaggggtggggaggcgcagtaagggcctccctgtaccccaccctcactgtctcccctcctcactgccgctaggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacacctcttgcctctcactacctgcccttctgtcctggggcggtttgctcctaattcccctctgtgatggtgcagagcgggtccatcacaccccagccgaccccagccgcacttcagagctgagttcccaaaggcagcactaagcttcctccaccctaccccaggggaagagggggcctgctgagctgctcagccccccaaaggagccgacccagatcaaagcaatagctagtgcattgagccctagggatgattacttggctgtgtacaaggcctccctcaggctgatttgtgcctctgggagggcacatgtcagggaggggtggggagaggcgggccagttctcaggcagcgcctgttgtgctgaccgggaaggtctgaaaagaggctgaagcaggtcaggcctctctgagcctcgtgggagccgaggcaggctccccgcatccctcaactcctctggctggcaccgggagtaagggcaatccaggcagaggggcagggtggaggagggcgcgggggtcggggtgtggtgtggagagtgaagagagcagtgacccagcacagtccgctgacgctgaagccagaatcagtgggcccggagccatggtcccgggattggagtcactcgggattggagggtgccatgaggtcccgggattggagtcactcgggattggagggtgccatgaggtcccgggattggagtcactcgggattggaaggtgccatgaggttccaggattggagtcactcggggttggagggagccatggtcccgggattagagtcactcgggattggggggtgccatgagggccactgtctgcttccgccttgtgctgtgtgggggcagctcctactggctcaggaaagccaactgctgaattctcaacaattttgctagccagttgttaatgatcattaacaaattatagaagcttacaatttgtgttattaaaagcaaaatcggcaaacgtcacttcctacttatttctgcatacacgactgttttctctgcccctcggttatgtacatctgtgggacctatggacacaaacaccacataacagggtgctgagggcatctcctccagctccacgttaaatgacatctaactggtagcttgaaatcagccgtggtgggaggaggcttgacttatggttacttgtctagacttcagatgataaaatgcagattagacttcagggtgctgtgtctatgctcattacattgtgaatagcacaagttgaggaaacgctcttctagtttccgaaaaccatcatctgattcaacaaagtggctcagatcaccgacgaagtggagaagcttgacgttctccttgtttcccttttgtcttactcattagcttgaaggaagaggagccaactgtacactcacagagggggccatcaacactcacatgcacacaccgtctcaccccagaggttctggacaggcccgaaggccaaccttgctgaaattcaccaccctctttgggaggtgacctttcaccacctcccacctccctgacagagaactggccaggcctgaaaacctcaggagtgggagccacgctcccccttggattggaatgtgaatgtcatgggtctctgcccgcgttccacacctggccccaagcccccagctacctgctggcagcctaggaatagcacatagtctgggcagcagaatcaggtttattggagggattgggggtaggatgagcacggcatggggcttgaggtgtgtggagggagctcagcaggcccagaagcccccttccaccggcaaagtggaacccgtggtcatgccacttcggtcactcagcagaaagaggatggcgttcaccacgtgctctacctctgtgggcagggcgggggtcaggggcatagaggaaggaggctgccgcccatctttccctcccacccctacccagggcacacacagggactgctggcaccacgctggctgggctcccacctgactcaccagcaaacttgccaagtgggattcggttcagcatagtcttggccttgtgggggtcactccaggtggcctggcccatggacgtcatcaccactgtggggtttactgcattcactcggatctacaccgggacagctggggtcagcagggcaagtggggtgtcctaggttgggggaggtaccccagccctgctcaccttgtggggcccgagctctagggccatcaccttggtcagcatgtccagggcacccttggtggagcctacgaagaggaacccaagctggctggggctggggtcggtgatgagggcgaggctggggctggggtggggctgagggcacagctggggcactcacagtagacgctatggttagttactgcccgctgggagcactggctggagacattcacgatggcccctgggactccccgggctattaagcccctggccacaatctggaatcgcagcgagaccgtgaggcagagctggcatcactcacgagaattcccgtccagcccacagggcagctcacctgcgacacctggatgaccgcacgcaggttcacctcaaaggatctagaggccgagggacagaccctggtcagagattagggctgctgcgtcctccaggacagcccctccctgaggttcctccgccctcacaggctcacctgtcaaaggcctccttggtgacctccaggaagggctgcagcagggcgacagcggcgttgttcaccagcaggtccacggggcccacgctgcccagcgcccgctcggtggcctcccagtcacccaggtccacgcacacgggttctatccccgggcactgtgtgtatcagggggcagttaccagaggctctgtgcccagcaagcggcacagctggggactggggctggtgacctttcagccggacaagtaaaggagttaggagttccgaaggtgtcgggactgtggggccagcagccgggcgctacctccggccggttcacttcctccctgcgcccgagcgactcctgcccggggcctgcttcgcagccatttcggcctctttctgagcccgggggccccggcggctctgccgaccacccggccgcccacgcaggccaccagccccgagagagggtgcgcgggcgcccaggccgcggtgagaagcgcagcgcccgcgaggggaggcggagtcgcgcacagaggtaccgcccccgctcgctgccgccccctcctggctcgccgcctcgcagcgctgggacccggcgggacctacctcgcggacaaggctgtcaagatccgcctgagtccggctcacagccaccacccgcgcgcccgtcgcgtgcagcgcctggaccgtgccgcgccctatacctgccgggagcgggctcagtgaaggcgtcccctgcccgcctctgcccgccgccggcctttgcccacctttccccgccgcccacctttgcctgccccggtgaccagcacccggcggcccgcgaggaacagctccatgtcggcgcagtctccgccctccgcactggggctgcggaacttgaagctctggccacgatgggcggggcgcggcggggccaatggcagggcggccttcagataggcggtggggacattcaaatagctgctccccgctgcagtgattggccgaaaggagtgggcgcgccggggcggggcggggtctccgctgcctcagggacgggtcttttgaagtgcctggtgtgacccatcttccgtgcttgaaatcgacgtagtggaccctggctagcatatttttccctgccaagattattgcaaaaagacgatgtggtggttaatatcggaaagaatgtgtggttaatatcaggaagaacacgtgaaatggagaatttcagggctaacatttcttgttttgtttctgaaaacatcggcatgtcctaaaaagtgtcgcctgtgcccatcatctctcaggcttgggagcaggacaccgccggctcactttaaagccaagggaaagaatttggacaaccaactacgtctggagaagacaccaatgtcagcagagctccgctttcatctgtgggcgaaggattacctagatgccaaggcaagagactgaagacacaaactgtttcagtataacaaagaaaataggccgggagcggtggctcacgcctgtaatcccagcactttgggaggccgaggcgggtggatcacgaggtcaggagatcgagaccatcctggctaacacggtgaaaccccatctctactaaaaatacaaaaaattagccgggcgcggtggcgggcacctgtagtcccagctactcaggaggctgaggcaggagaatggcgcgaacccaggaggcggagcttgcagtgagccgagattgcgccactgcactccagcctgggcgacagagcaagactccatctttaaaaaaaaaacagttaaaataaaaatagtcataatacaaattagatataaaaatgatcatgatcatggataattatcaatcattagtataaacattattaatcattagcttttaatattactctttgttgcattactaatataacctagggacattgtgagaagtgacctagaaggcaagaggtgagccctctgtcactcccgcataagggctgcttgagggctccttggtcaagcagtaatgccgttgtctgggaagccacccgttacttagaagactgcgaaggggagtctcctttccttggaggcgtcagggaacactctgctccaccagcttcttgtgggaggctggatgttatccaggcctgcccgcagtcatccggaggcctaaccccctccctgtggtgctatgatttaatggtcacatttcttgtccacttccatgttcctcccgtactcctggttcctctttgaagttcgtagtagatagcagtagaagaaatagtgaaagtcttaaagtctttgatctttcttataagtacatagaagaaagcgctgatgtatggtcttctctttctgtttcagctacctaaaagggaagcgccccctgtcctatgatcacgtgacttgcttcaccttgtcaatcacttggaagattcaccctccttaccctgccctccttgtcttgtatgcaataaatatcagtgcgcccagccattcggggccactactggtctccgtgtcttgatggtagtggtcccccgggcccagctgttctctctttatctctttgtcttgtgtctttatttctcacaatctcgtgtctccgcacacggggagaagacctgctaagccccatagggctgtaccctacattcatctgaaagggacttgaaccccaggtcaccttggacagccagcatccggccaggggcaccttttagaagttgaataggataggaagggattggggtcatggaagtacatggtggtccagcaaagaccagcattgcttcccgaggctttggggtcagttacagatgcgtgtgtgtgtgcacccacacactgggcctccatgtaaaagctactttgttctgtgggtcatggtaggaaagtctagaactactgcccttctgtggccaggagtgaccttctgtggccaggagtatggaattggtgactgtagggcctttggatcatctggggctttgggcccacagaggtggacaggccggaggcaagggtggccaggcacagcaggaggcaaggtcctggtttgttctggaggacagccaagtgcatggtccatatcagacctggcactgcggccagtccaacccccccttggccgccctgtaaactctgctttctgcccctacccttggagcctgctttctgcctgccagcagccaagggaaggacacccctcaacctgtccttcctggaaggcccatctgcttagacccctccagcggcctgcacgtgcccccaggagagtggaccaggcctcactggtcctgttatccgtggctcaagccctgctccctgtgagtcctgctggctggtcagaagcaccctcggcatcccctacccccaccctgtgccctgtgccctcccaaccactgcctggagggcccgatcctggcccctagccctctgccctcttgcccagctttggaagattcccaaggtctgggtaaagttaccagtatccagattccttctcgagctcgaaccaacattacacttttcctagagtcaaaacgggagttaacacaagtatataaatgacaattaatacattggatagtttgattgttcgtccaaattttgatattccccactaacagcatataacgaagcttaacacaactctataggaatagtcacattggaggtgaacaaagcagaatgtctgaatctacactgatactgagggagaggagcagtggtggccacacccgatgttatccgctgtcaaaaagcaatttgaagggccgggcgcggtagctcacccctgtaatcccagcactttgggaggctgaggcgggtggatcacgaggtcaggagatcgagaccatcctgactaacacggtgaaaccccgtctctactaaaggtacaaaaaattagccgggcgtggtggcgggcgcctgtagtcccagctactcgggaggctggggcaggagaatggcgtgaacccgggaggcggagcttgcagtgagccgagatcgcaccactgcactccagcctgggcgacagagcgagactccgtctcaaaaaaaaaaaaaaaaaaaaaagcaatttgaggtgcccggggatgctgaagaggtagagtggcatacctgggttgagaaaaattatcgtaatgccaattggagtcccataaaagaggactggcatcaaaaagaggaaaagggttcaaaggagatttatcatggggttcagaatcacggacgcgaggggcggtagcagggacaacagacagaaaagtttccccttcccatactcgcagtctggatgtggcaagagccaattttcaaagttctgggtgttctgagctcagaatggggagtatcacacgagccctcgggggacaatgtccttattttcccattttaagggaaagaaagagctgaacctcctatacaaagtaaaatgatgatcctcgttcttccaataagaaataaaacaagtagcctccaggcattccctcccgccacaggagcaattgttttttaaatagccctttggtacccagtctattactaaaccatatgagtcagttttggtttttttttttgagtcgaacaagcatttctgtgaaccggaccgatgaacgtttctacacaactaccaaagggaagcgggtccccacatgcactcaggaaaaagaaaagccacgttggcgcgccagatatcgggggaaccagcccccagtatttcaatgtaggttctttctattttccataagtgttggctggctgagaaatgaagagaaagagtacaaagagaggacttttacagctgggcctcccagggcgacatcacatatcggtgggaccctgatgcccgcctgagccgcaaaaccagcaggtttttattaaggattttgaaaggggagggggtgcaagaacagggagtaggtcacagagatcacatgcttcaaagggcaaaaaggagaacaaaggcacttcaggaggccaaggccagtggatcacctgaggtgaggagtttgagaccagcctggccagcgtggtgaaactccgtctctactaaaaatacaaaaatcagctggatgtggtggcacgtgcctgtaatcccagctactcaggcagctgagtcaagagaatgatttgaacctgggaggcggaggttgcagtgagccaagatcgcaccattgcactccagcctgggtgaccagagtgaaactccgtctcaaaaaaaaataaaaaataaaaagttttaaaaaaatttttttaaaataaggctgggcgcggtggctcatgcctgtaatcccagcactttgggaggccgaggcgggcggatcacgaggtcaggagatcgagaccatcctgactaacacagtgaaaccccgtctctactaaaaatacaaaaaattagctgggcctgttggtgggtgcctgtagtcccagctacttgggaggctgaggcaggagaatggcgtgaacctgggaggcggagcttggagcgagccgagatcccgccactgccctccagcctgggtgatagagcgagacgccatctcaaaaaaaaaaaaaaaaaaaaaagactgagccctcagagacacagctgcagtgaaaccattaaatggaggccagtagcatgtgaaccacacaggcagggccagagggagcacagggggcttcctggagaggtgggaggaaggcatgactgagagagagcacgggggaccctgggagggagaggccacctgttcctggcctcatgtctgtgtgcacacacgcagaggcacatgccaatgtgagcacaagcacttgggcatacacacagggacacacacaggcacacatgggcatagacacacatgagcattcacacggggacacaggcatacacgggtgtaggcacacatgagcatgcacatggggacacacacagacacacacgggtgtagacacatcagcatgcacatggggacacaggcacacacagatgtagacacacacatcagcatgcacacggggacacaggcacacacaggtgtagacacacatgagcatgcacacggggacatgtgtgtgcacccggggacacatgcatgccatggcacagcagccacacaggacacacacacacacacgcacacacgggcatgcacacgtgagcacacatggcaatgcatggaccaggcagccacacaagtgcacacatggagcatatgtgaacatgcaggcctgagcatgggggtgcatgcactgcagctgacaggcccacagacatgcgtgtatacacatatgtatccacaccccccacaggcatgcacaagtgaatatgtgtgtagacacacagtcgcacacggacacacacgctctggtccatggtggcaaagaggaccctggaaatcagcagcttcggcttcgatgttgctctctgtgaggatccctgctaggagtcagggttggccaggaccctgtccctgggctcaagtcctcctgcaggagagccaccctcaggaggggacagaccctggtgctccctgaagctgggccatgaggctgagcttgggggagagcaggtgaaggcggccaacgtggttacaggtcttgggtggctgctggccttcctggctgagccaggtttgcacctggtgctgggagctgggcctgagccttgagctctggaaagcaaccataggtgggggctggggaaaggctcccgctccaggaggaaagccaagggctccctaaggccatattgattcttctggacaatgagggggtcaaaaagacctaagaacccccagctcccatcttccacgggacagctggccggtccttccagctctcaggatggtcccatgtggcgaggcaacagcaggggccactgttcctaagacgaccggatgggggtggggccctcctgttcgcgtccggccttctgagcctctgtagtccctacagagaggaggatatggggctcaggcttccccgggagcccaaggccgggaggtatgatcgactctgcgggtgtctgtgggctcagtgctaggcccttcctgccataagcaccccccgccgtggaggagcatttgagctcacggatgctacagagaaagtttcctacagggtctcctctgagggccatggaaagccatgtgtagacactcagcctgcccccagagcctttggtgccccaggagtagagccaggagccctccccgccacctccatgtgccctgtgcctgggcgcccaagcctgtggatcccccagcatgggctaggcaggtccttcattgctcagaccccaggctttgggaggtcgcatgttttgccgtctgcatagcgaggacgtgctgggtaggaaaatgaactccaagccacggccttcctggccattctgttgtcacccgtcgtttccttcacctgctgtgaaagtgcaatcttgcttcgctgcaacctccacctcccgggttcaagcgactctcgtgcctcagcctcctgagtagctgggattacagatgccctgctaatttttgtatttttagtagagacagggtttcaccatgcctagccaggctggtctcaaactcttgacctaagatgatacgcccgccttggcctcccaaagtgctgggattacaggcatgagccactgcacccggccagttcttttttttttttttttttgacggagtctcgctctgttgcccaggctggagtgcagtggcgtgatcttggctcactgcaagctctgcctcccaggttcacgccattctcctgcctcagcctcctgagtagctgggactacaggcgcccgccacctcgcccagctaattttttgtatttttagtagagatggggttacaccgtgttagccaggatggtctcgatctcctgaccttgtgatccgcctgccacggcctcccaaagtgctgggattacaggagtgagccaccacgcccggccaaacccggccagttcttctttaaatgtttggtagaatgtaccagtgaaaccatcaggcccaggacttttccttgtcaggagttttttgattactgacaaggctggagtgcagtggcaccatcacagcttgctgtagcctcaacttcctgggctcaagccatcctcctgcctcagcctcccgagtagctaggattacacgggcacaccaccgtgcctaattatcaattttttttttgtaaagataaggtcttgctaaattgcccaggttgggttcaggtgatcctcctatctccgccttgcaaagtgctgggattataaggatgaaccaccatgcctagcctcttttttcttttaattattattttattattttttaaaatttttgtgggtacatgggaggcatatatatttatggggtacctgagatgtttcgatacaggcatgcagtgtgacagacacacatgacggactatggggtgtccaccccctcaagcatttatactcattttagtattattattttttaaatttttattatttattttatttaattttcttgagacggagtctcgctctgtcgcccagcctggagcgcagtggcgcgatctcggctcactgcaagctccacctgccgggttcaagccattctcctgcctcagcctcctgagtagctgggactacaggcgccccccaccacgcccggctaatttgtatttttagtagagacggggtttcaccgtgttagccaggctgctctcgatctcctgacctcatgatctgcccgcctcggcctcccaaagtgctgggattacaggcgtgagccactgtgcccggcctattttagtgttatttttaagcggctccacacagagcagggccatgccacaggcagcgtggcccagagtagcctcttttctaatgtaacgtttgcgactgtaaatatctccctcagcaaaatggtatctcctaagttttaagttgtttttatttgtctccaggtattttgtgatttcttccttgacccactggctaagagtgcgttgttacatttccacaaatttgtgacttttccagatttccttctgctgtgggctcagagatgaaactttgtataatacattttattctgtttaagagatgggggtctccctatgttgcccaggctggtctggaattcctgggctcaagtgatcctcccgcctcggcctcccaaagtgctgggactataggctcgtgccactgtgacagggtttagtatctatctttcaaaacacactgagacttgatttgtggtctaacatctggcctctcctggacaaagttctcgtgcgctcgaggagagcatgtgttctgctgctgtcgggaggtgctctctggacatgttggagctggtggtttcctgtgttgttcaaaactcctagggctgaagggaggtgtccactgagtgtggacactgtctcatcaggtaccatgacacaccccacgtgacctgtgcctgtgaccacgtcgctgccttgcgggcctaacagcacctgcctatgggaccttggctggctgcttcttaccaggccggccccctagagcccccctgctcctccaagccctgtttcctccagaggggtggccgcccctggttccctcctcacccctgtccacactgactctctgcagctggagccaactgggtccagcagggacttgggcctgggacggccaggggctctgcccagaacagcgagcctgggactggtcctgcccgggaatggttatttgaatcaaagcggaaaactgctggtttgaaacgtttataaacataacccaacaatacaaaagggagcagcgtaactggtcacttaggagaaaagcctcaggacctcgtggacctgaacttaggccaaaaaaaatggggaggataaatgagacagggtgacctcccggaccaggcactatgcaaccttagagtgtggcttaaacatgaatgatcatctcctttccgttagacagcagtaacaggctttaggttttaagactagtgttgacggagtttaggtaaaacggatacaacattatattctcagaggacctgcaagctggactcttccggaaagcgtgtgtgcaccaagatttgctagagcctcatgccctggaaacaacccactggggacactttgtccctagacaccctttctggtggcgtgaacgcactctagtccacgttccccactcccaggatgccgggaccgtgtggcgcaggcttaggagggagggaggtccacatgaggtcagagaaaagcgcaacacccagaccgtgcatccgggagagccagcgtgaggccccgaggccacgcgggcagacccaccgcggacgcaggggacgcaggggacgtctacagttctgcagcaattttcaagaattcgcttttctttcgtttctgttgaaatgcaggtttcagacttgctgaaattcacccgacacttgttctgagccccagaattcctctcccagcccagagcctgcagtggacaaagccaagggcctgggctgttggctgaggacccagtcatgattaacctcaagtctccttggggtgccttctactccaggctgagcacaaatgagacagaaaccagcgaactccacgcgcgttatgtgggtgcctcctctttgccctccacacacccacgcacaagtgcacacacccacgcacgcagacactgccacgcacacacccactgatgcacacagacgcacacacgggtggatactcacctacatgcacgtacacacccactctcaatgtgtccactgagcttcgtgtacacgcccacgcacacccaccctcatacacacccacgtgcacctggctccacacaacacacgggaggaggcaagcacgatgctcaggaaggcggcctctcagggcagcgtccagtgtccgtccctcccggcgggaccctcgcacgccacctctgctggagattttggcttccaaagaagagtctggtgggttcaaggctgggtgggcaggacggcaaggatacagccctgcctgggacagagccttcctggggtagaagggggatatggcagggacccgaggagagctgggccggtgggtgactaagacaggagccacgtgaagtaagaacaaaagctttactcgtgctcggcaacagcaaagcaggaggcagaggggagatgacggcccctgtcccatttccctccatggaaggcaccaggcggggaggtgggtctgctgggatgggcaggtcagcggaacaaaaggctcctgttgtttatgggcccaggcacagtggggcaggagcacgacccagaaagtagtcctgagccacaagtcagagcggagaaaacatctctgtggtcccagtcaagaggcctccgaatgaggcgcctggactgggagcaaagctctggtcgagaacatgaccttcccgggcctgagtcccactgtggtgcccggccgtgcacccagcctgcggcagagagggcggcgtcccccacaaagcctgccaggctgagcccttgcaatggccgtggctgggccaggaccttggcctggagcctgctccttgacacccagccagcctagcacccgccttcagcaacaggtaatggagcccggatggcagctccctcccaggtgcgcaagtgctggggtggaagcctgttcccgtgggatcaaccttggggctgggtcggggggaggggcactgcggccctggccatcagcctggctgtcttcgttctcccaaaacacccatcaccgcagcccaccaggggctgggagagggggggctgcaggctagccagagggtctgccaggtgcctgcatctcactggtgtggccgtggcacctgagggagcccactgagcccatagggggctctggttccccgcgcctgggacagagccaggcagccctgggtcggggtggttggtgtcaccgagaggtcggggcgccctgtttctgcctgggacaccagtccgtgtctgggtacagaagacaatggatagacttaaacctggggaaggaagaagtaggggtcagggccgtgggcggagagagaagcgggggccagggccgtgggcggcgggagaacctggggtcagggccgtgggtacagggagaagccggggtcagggccgtgggcggagggagcagcgggggtcagggccgtgggtagagggagctgatgccagagcccctgcggggccgagggcctgcccatgccactacctactcaccgtgtggggtcttgatgcaggctgaagcctccagccacgttcaccacgttatgtgggttctcaggacccccatggctcaaggtaacctgggagggaagggtgtgggcagagtgtgtggcctggtctggtctcgggccacgcctgcccctggccaggagccctgctagagcccctttgcccaccccctctccccaggccctcggggaggccaggcttggaaacagcattgaagcatggcatgagctgagtagggggacacctcaggcagagcctgggggacagaagatagggatctgaaacctccagggcaaagctgaccctcattccctccctgctccacgtgatgggacctgttccgactcaccatcaccatacacaccacacccactgcccagctggcatggggcctcactggcccgagaactgtgcttctcccctcgttcctctgccccagacaccataccccatctgtacgtgaggaccctgtgtccaacaggccaaggggcctgtccagggtccacccccagccacatgcaaatcccacctgcctgctcagccgggcatcgggccggggcagtggggcccctgggggagtcagggcggggcaaagcccaggtggcagaggcacccagagtggcgcctgtacctgctggagcagggtgtcgggcggcagcctctgcaggttctccaggtgagagtggaagagggggctgtgcagcaggcgggcgcccaggagcccctccacgatgtagccaactgtgcagtcatccggcagccgcacctgctcagctgtgctcatgaagctgcccaggctggggggaggccggtcagcacctttcaggtctcagcctccgcctcccagcccgggcagctggacccccactcacctggcccatgggctcatcttgagggcaaggcctctgctgaggcagaacccggccccaccagtagcaaaccagaacttgaccgtggtcacctgaagatggggtggtggtcagagctgcccaggacagggcttctcacccctgactcttcatgggactccccaggcatctttcttaagctgccccttaggagatcccacccaggtaacagaagcttcttggagcaaaaagagccgggggcttctgcaggccattgacccgtagcctccagaccctccccacctggcccagacaccccctctctgcccagtacggtgagggcctcctggcctgctcctgaaacaccacatgcaaaccacctgggtggatcagcttgggcccccaaccctatgcccttctcaagccagctttccacgccctctgctgtgcctcccgggctggtgtcaaggaaggcgtctgctccgatggcgtctgctccgacactcacagttctgccaccctggaccctctcggtggcctcaatggggtggtccaggctgggccgccccaggtagacgtcctggctgggtgagaagctggagagcaggtgcaggaggctcctggcgttcacataattgtcatcatccacgtggcaaaaccacctgtgggcgaggggagtcctgggcacgagggcctggcatggctggacaggaggcccccacccagcttggctctgagctctctgcgggtcgggtcagcgccgcgtacttgcgcccggactcaatgaacttgtcatactccacggacatcttgcagcagagggcctgacgagtgcgcaccgccgagcagttggtgttgatgacacggtcgcctgcgaatcagagacgggaagcacgcacgtagaggatggcactggggttggggtaaggcctgtgccccacctgcccccaagggccagggcacaacgtggctgtctgacatgcctggacaccttgcctgggtccaaccacagccctagccctcacgcgctgaccctgctggtgccaccgaggctgaagcaggcggccatcggttgggatctcttgagtggaaacaggacggaggcagctcgccctgacctggcctggaagggcggattccctgctggcgcttcttcaggggacgtggcactagccccacgccccgggaagcggctagtgtgagaggctggtggggagcagagcttggctggcagggtgggccctccgcaggccgcgtgacctgggcagcgtcggggcctccccgggcctcgggagcctgggcagagaaaggcacccacagcagcgaaggggccgtggcttcggagcgagaaaggctcggggggcagatcccgcgggcgccggggagtgggggacactcaccgccctggagctcgagctcagggtcgtccccgtcggtgaagataaacgtctgggggagaaacaatctatgaggcttctggggcgctgcccaggccggagaccgacccgccccgcgcggagcctccgggggcctgggccgggcctagaccctgggaggcggggcgggtgggcgtggggctcgccgtcggggtcggggtccggcgcacctgctggcgggcccgggagatccaggtgcgcagcagcagccgcaggcgcggcccgtggttcttccgggtggtcttgacggcgatgaagacgtcgtcaggccgcaggctgggggcagcgggccgggacgggggcgcgcgcggggccggggcgggggtccgggccggggcgggcgcgcggggcagcggcagcggcagtaacagcagcgcggccagggccgcggccagcgcgaggcaggcccggcacagcgccccacgcgcgcggctcatgcggccgccgggacccccggcgctgcgagcggagaacctggccggagccgtgggtgggcggcggcccctttaagaacgcagcggccccgccccgccccgcgccccggaagcgacggcttcgctgccccggaagtggacggcacgccgcggcggggtgggtgcaagatgccgctgccggttcaggtgtttaacttgcaggtaacgagccgaggccgccccgggcctccgcgcccccgcgccccccgccactggggccgggctgaggtcgagcaggggcgcggggcctgcgccaggagtcggtcgggcacgctccgtgccgggcctccgcgggcagcgcgcgtcgggggctgcagggccgagggcgcgtctccgccgtggctgcgcgctgcgatcgggggccgccgggccgcgcccgccccgcctcccctcccagcagctcacgggagaggttcccggccgccccgacgctaacgctctttctcccttcagcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcacggccggggacttcagcctgagcgccagcctgtcggcctgtacgctgctctacgaggtaccttccaggacagggacccccgagcgagggaggggggagcagggccccggccgcccctgctgtggctgggcccctgctgctctgctggccgaggacagggactcagtgccaagcgcaggaggggagggagccccggtgggcccggggcctgcggagggagccgagctcttggtgcttttcccgaaggagcgcgggaggcccacgggtccggcgagtgcccggcatggcggcttttccagcctgctttgtgttaagccgaggtcctggcttctctgtgtctcccagctgggggccatgaggctccctgagatgactcttttccccttctcccaactccgtggcgtgactctcagcccagtattgctgctccgctgctcaggacagattccgggggctggtcctcctgcctcctggggttgaggtggcgtcccgttcttctccgtggcttggaggaaactacatcaggatggtggctgggaacgtgtaggggccctcagaggcccctgtgtagttggttgtcccctgtctgctttctggctttcagagatgagcggctagaatcaggcgaggggtttctgcttctgagccttagagtcttgtgaggagacccctccctgatgtggtggcacaggagcctgggtgggggcgggggtgactgggagggcacacctgggggacagcagcggcgggagtgtggtccgactggcctggaagatcttgggcagagctgacctcagagaacagtgcgggtctctcgccctcctggggcagtccccaggacgaggtgccaggtgcctggcccatgttgcagggggccgtggagcccatgcagatcgacgtggacccccaggaagacccgcagaatgcacctgacgtcaactacgtggtggagaaccccagcctggtacggagcccagtggggggaccttgggtgtctcagtcctgctgaggggtccagggcacactccccgctgcagcctgcacagcaggtagaatgatcctcctcagtgatcgctgtcgtctttttctgaccccgaaaccatcagcgtttctgattgcgcactcacatgaggcttgtagctcagcttcagatgctgctcatggagaagccagggcaggtctcctccccgctcagcctagcgaccagcagtcactagtgggtgtctatccccgaaagcccccgggtgcagggtcccactcctgaggctcctgcgccaggcccaccccagcggtcttcgtagctcctgggacagcagtcagtctcgtacccccatgcccggttctggttatgggcccagggcgacattctggctaggacagtcaggccccaactcctgaccctcagggcctggggccagggtcctgcctcccatcctgcctgactcttgtctgtgcctgctcccaggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaggtgaggccaggggcttggcgagaggaagcagaggccaccaagggagcgcgggtgtctgggactgggcccccttcctgtgccctgcatctcccacccctgtgctgggaagtcgggcgggtagagctctcgctctcttttggccagcagtggaagtgccctgtgtgtgtgtggcttctgtgtgtgtgcatgcagggctttgattccaaggggagctgttggagactgtggctcaggggccgcctccctgctggtttccccacccggctgtaggctcctggggcagcagttctctctgtggccctggtgcagactggtccctagaggtggggtttgaggccagcgggaggtgcccacctgtgtgccggttgggcctttgagggcagcctgagattggcggcttcctcccctcctccctggcccccgtgaccgccgccatcctgatggccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcggcctgcctcggcgggcgggggtgggcagcatggctgggccattggggcgcccgggctcacttggctctgcgcccccccgccaggtcagcgtctacttgcagaattggtctcatgtgctcagctacgtcagcaaggctgagtccaccccagagattgccgaggtacgggccacctcctcagagaccttgcccccaggattcctgaccactgctggcccctcctgtcctcccccacctcattctcccccagatctgaatctgccttcatcccctctcagtctgggggctgggcatcgagctctaggaaatgtggagcatgggcctcacgcatgtggcttcctcctacagcagcgaggagagcgtgacagccagacccaggccatcctcaccaagctcaagtgtgccgcaggtgagggcctgggtcacgcccagctgaccccacgttcccctgttgctaagtcctcccagcccagggcagtaggctggtccctgcctcagccagggaaaacttccctggcagggcgcaggatgttgtgggcacatgtacaggtgtaggtggtgcctaaagtctgccccggggaagccagtgggtgacgtgtggtcagggtctggctgctgtcactgtgggcgtgaggcaggtctgccagcccgagctgctctgaactggggtgtcctttgcagccctgctagcacctagggcttccctgcatgcctggcttcagggagcctcctcagcattggtggggctctttccacccgtgactagagtatctgtccccagcgctgaggaacagctcccggggcaggagaggccagcgagccggctggtggtcgcgttctccctggtttccaggcgttagcggcttccccaggctctggggtcttaccccctctcccccctccccgcccccggctccttccactaggcttggcagagctggccgccaggaagtacaagcaggctgccaagtgcctcctgctggcttcctttgatcactgtgacttccctgaggtgaggagccctctggggacttgggaggcagagcatgggctcatgggtcaggctgcttctgtaggagggtgaggtctctcacaaatggggtcttaggcattctccgagcgggtgatgggcaggcaggggtggcctggcccttcactgcctgtgacgccaggtctctgctcctcagctgctgtcccccagcaacgtggccatctacggtggcctgtgcgccttggctacctttgaccggcaggagctgcagcgcaatgtcatctccagcaggtaggtgccccggtcctgcagccctgaaggctgtccccgtccctctccgtggctgctgcttcggccttgcatgtcctggccccctggccccagcgttttctcaggtgtttgtctggggactggtgtcccactggccacttggagggaggggcaggcagaggacagagttctgaggggtctgcctcaccagctccttcaagttgttcttggagctggagccacaggtccgagacatcatcttcaaattctacgagtccaagtacgcctcatgtctcaagatgctggacgagatgaaggtgggccccgcctggggtaggggtgaggtggggccctgcctggcctcctgtcctggtcctgaccagccccttccccaggacaacctgctcctggacatgtatctggccccccatgtcaggaccctgtacacccagattcgcaaccgtgccctcatccaggtaagcgtgggggtcaggctggcacacggcaggcgggcatgcagggggctgtggagctgacttccctctgccctgcagtatttcagcccctacgtgtcagccgacatgcataggatggcggcagccttcaataccacggtggccgccctggaggacgagctgacgcagctaatcctggaggggctgatcagtgcccgtgtggactcacacagcaaggtggctgtgggctgcggggcggtgggggcagctgggggtgagcctgggccccgctgagcttgtgcctgcacagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaaggtgggctggcttgagggggggcaggcgcacggcgtgtggggcctggtggctgtgagctgctccttgtctcccctgcagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgttgctcttggctgttctttcctgccgtgcaggctctggtcacccctgggtggccttgggttcctgagggctgtctccctgggactaggcttggaggcagggcctggtgagagaaatgagaagcctggccctcagattcaacagcccccagcagcagccactgtggcctcgcaggcggtgcttccaaggctgtgaggcatcacgaagctcccggaggctttggccacttgcctatggaggcgcctaggggaggtggggaggggacctaagcccccacttttgtctacccagatgctgccttcatttagatgtatcctgttgttcagaagcccccactggccccaaccgcacctgccccggctcatgcctccctgggtctgagagggcagtggtcacaggctgtgggctctcgcatctttgaaatgatttattgttcacttttgcacacgcgtgctgaggacagggcaggtccagcctggggcctgctccccactgcagcatttccaggcccccagagtgggccgaagggggacatgggcgtgtctttccacattaagtagcaggagattccctgagtaaaaggcattttcttaagtaggacgtgtccaggctccagcagcagtcctgggggtgggggttgtgggccttcaggccagggcactgcccatgacttcggagaagccacctggtgttccaggtgctgctggctgaggctcctgcagctcaggctgggcctctttccaggccagagacttctccaatttggttttaaaaagcaatccgtgacctggcagagcgagtgagaggagtcgggggtcaggaggcggagggggtctgtttgcctgctgcggggcgggtggtaggcgccctcacctgggcagtctgcagtctctttggaggctcgcttcttgcagcagccgcggcacaggctgaacacacatctgttgccctgggcacaggaaatctcgggagcctgtggccagcaccactcccggggccaggctggccagcaggggagcagccccactggggaagcctctgccagatgcccacggcctggatgcagccctgggaactgctcccaagccagatgcctctccctcacccccacccacccagactctcttcccctccaggcctgggcaggggcttggctggaagcaaggggccgtcctgaggcatccatgccaccttgagccacgttgcaaacccagctgggcgggcaccagacctgccaccccaagcagtgcagagaccaccctgcccacccccaaagctgaagccttggtggcttgcagccggaacccactcacctttgggtttccacactggtcacactttgcatattttgctaggaaaagaacaaaagggtgctggtgagtgagggccagggtgccctggctgtgggggctgccccgtccgcctgcacggagcctgctgatggcgtccatgccagctgtggccagccaggccaggaggctcagggagggcagaggatgcaggctggccacgtctgcttttccttccgtgagcaatgggtgaggggatgcagggggcaccatcctgcaggaaacggataggaagcaggtgggctggggggccgccgcaggacgagcagccttatctgtcctacccccaggcagggacaaggggagcagttttcctgcccacagggtccaaggggggttccatgcccttcagttccaggtctcccaagcaaaagggccaagaagggtcaaatcaagaattcagcctgaagccccacttcctgcctctcccagctgcctcattcagtggcctggtggggggcagtgtggcaggcagggactgctggcaccagcctgatgtggcagctgctcttggactggccagcgccctgggggttacatgggaaggtttcagggttatcgctggtctcccctgcagcttgtaaagttgtcagagatctgggaggctgccacctgttgagggcccagatgggctggcccaggatacggcggcgaccaggggtctcaggggagacagcactaggctgaggccttgccactggtggctaagagaggggcgagcagcctcgtcccgtgcctttggcccagcaacaagacccatgcacacactcccggggaccccagcctccctctcagcagctgctcaggtgtcctgtgtgaggctgggcaggggcagccgcagggacccgaggccctgagctgtagacgagcttcacctggctgaaaagcttgtcccatagcctcatctgattcactgagcccatgtcccacatgcacgggctgtggcctgcacagggtccccgttctgaccccaagtctggctgactactccgccaagccctccaggtgtctgcttccagctctgggccttgagccttgctgaccacaagtctgggttcctgttactggcaacagggaggatgggggtgatgaagaggctctctcgggcccatcagcggaagcagcacttacgcttcagagaggggtcgaaggtcttgtgggggttcctcagctgcttcttttgcttgttcttggacaggacctccgtgccaccctcctcttcctccagggcccgcttgctgcgcgcacctgccttctccttgctcccctccctgggcctgaggggagggcagcgggcagagcccaaggacactgtgagaggggcccagcagccacagccacacgggtctgagtctgggtgaggggccaggcggccgtggcgagtgccgctgctgtgaggagtgccctcctttccctcgggcagcccattcaggactcgtcactagggagtccggggcctctgagatggagtccgcagctcgggcagccccaagctctgaaccaccagctccagggagggctgtggccacggatggcctcacctctgagaacccagcagaagctggggtcaacctcttgacccacgggcaaatccaccaggatcagaggagctcagagaagtatgttatggaagaaaagatttaaaatccgagcgtccactgagggaggacacagctgagccaccagcatcctccaccaaggacaccgaggggcacgtggaaggtgtgtgctgctcggagccgaggcctccctcctcctttcccttgggcaggagatgactgaccataatggctgaggacaagcagggcaggcgcagcactgtgggcacagggtggagcccacaccttggtgcacatccccgcccagggctggctgggctctcaccccggccggatgtagggctggcagatccagtggaagggcaagtcgccggtgggcttcgctccctcctgcctggatatctcctcctgcaaaagcccaaggccctggtcatggccccagcccctcaccccctgcaaggccgggctcccaccagccccagcacctgcctgacaccgcagcttcagctcctggctcacagcagcgatgccctccagggtcttcaccttggccagctcctctcgcagctcctggtgcacctgcagcctgagacagaggccctgtcacgcaggctgggctcccggctccaccgtcaggccccaggctgagcactgggcacacggggacctgtgtctcttcctgcccaactccactcctaagtcaccccagcccctcaagacctgacttagcagcaagttgttttgacaaaacctgcaaaatgccccaggtggggtctgacggaatctgcctgggcggccctccaacgtggcttctgccttagggggcaactcacgtgtggtgccacagcttgaagaggtgggcccggacgtaggacagggggcaggggtgctcccgcacgatgtccagatactcctcggccagctcccacacggcagggctccggccctcgaacagggcggggttgtgcaggttgccctctgtgggaggaggagcggggaaggacacctcgtgggttgctccaggtggacggcacaggaaagcctgggacactcaggacacccttctgtgccacctcacaagggacaaggccagctcaggcccatcagagcagactgggattgatgaacaccatctgtgaacagcaccatggggagggcagtaggcagtgggaggcaccgacctgggcggtggtatcaggccgtgtgcatggggccctggctgctgtcctgggccctgcccacctgcgctcatgacgccctgcacacccgtgtcccggaggcagcgctccacgtcctgcaggcactggatgttcccgttagcaaacacagggatggccacagccttcctgttggcagagaaatgcctgtttccacccgcccggaacagcacccaggtgatgctgcccccagccacggccccctgggtggtcacgggcgtcaggcgtgccgagcaccctgaggtgtggagctgggacccccagcaaagccccaaggactgagggctgtgtcacccacacccactcaccgcacagccttgatatgctcccaggacgctgcacccgacaggggccccttctgctccttggtgcgtccgtgcaccgtcagcaactaggacagagcagtggtcgcttgacccctccaagccccttccgcccctcagagccccctccgcccctccacgccccctctgcccctactccacccctccgagccccctctgcccctcccagccctgtgccccatgcccgactgcagggacctttccctcaccatatcagctcctgaagcagggctgaggaatggccatctggggcctaccccaaggcctctgcactctgtgggaacctcaggctgcatgtgctgcccaggcccatgcaagagccaggccgggaagtggcagcatccccactgcccaaggccaaaggtgtgggagggactgactccaggctagtggggcactgggggggaaagtgggtcctgggcctggcagcccctgtgcaagctcatccccgggtcaccaaggttgctgtccaccttcagaaggtgagtgtcttgaggggcacccccggagacagcagcccatccaggcccgcgccaggccaggctcagtgtgcggggaacacgggcaggggagcagctctgctgacagcctggtggccccttcctcaccctctagggagactggatgctgagtatccccaaaggaggccctgccggcctctgtgacactaggaatatgtcagagatgccgacattactctctccacagggacaaaaccctggagccaggaaagcagtttctgttgtagaggcctgggcttggggtggtggcactcagagccagtggggacaggccagtcaggagggccactgcccccatgaggccgacggtgcacggtgtctggacacaggaagagcctcagctatgtcctctgcgcaaaggcccagctgaggcccatgacacccccgcgagcccagggctcacctggcagccggccttctccagcatctgggcgtacctcacggtcttgtcaatctccgggaagacacggattttgcacgtgacaggaacagagagtttctcgtgggccagcaaaactggggagaagagaggcagcttctgagggggccatggtgttcccactttagcggccaagccccagagcccagggccctgcagacagcggagcccaggcagctttgccgggaggctgggaggcagcccgggccaccatctgggtgtctccctcaggttgctgggcaggctccctccgccatacccccggccctccgaagttcaaacaagcagggccaaggccggctctgtctcccaggacatctggggctgggcccgagcaaggactctgccctggcacctactgtctggttttaaggggtgggtggtgcaggacaggcaacttcacagccacctccttccagcagagaggctgctgtgggcaggaagccccagggtgatgctgagaactcctgccaacgcctgtcctctcctgagccccaaccaagtggacagtgcccatgtgtccctcttgagggtctctgggggtccttcaccatccacccagccaactcactcattctttggagcaggtcccactcgtcctgcagaaaggcgccatagtgacctgcaaggagcaagcatggcctggctggcacctgtgttaaggctggtggggccgaagccttgcaccccctctgcaccctttcctgcatccacgcaggccaggagctgccctgtcaggcgggacacaggtccccagaaccagcagtgtctccagttggggcagtgggacagtcagagcagtggtttgtcggcatcagactcaggggctctatttgcccagctgcctaagctcagaaggtgctgaatggaacccccaccctgcacggtctggaaccaagtaacacctcctcaggggcccggtgaggtagcaggctcagccccacacacagcagtgcaagggggtaatggggaccctgtatcagcaatcatgtttatgcagagggagctccctgagggaagagagagccagtagggctcggcccctagcccccaaggcctgaggacagccaccctccagaggcggagcacagaggacagctggctccagcctgagccactgtcacgacagaggcagggcctgccgtcctccaagctcaccacacctggggctgcactgagctggctctggcccctgccccaggtgcccccatgctccacatggagctcacctctcttggctatcatctgtgggcagcccaagttcaggtcaatggcgtcacagtaatcctgagccaggagagccgcctgaacaaacacctccgggtcattggcacagaactggagaagatgcaggagtcagccacgggcccagccaggccctagtcccttgctgcccagccctacgagaggtccagtgtgaccccatgagggtgtgggcccaggttcactgcaggagggtgctctgtcctgcggaggcttacaatatgacaaagccgggaggagtccccaagccacccggatttacagattttcttctgaactgtggcagaagccacaatcactgacttctgaagagcagagccatctccactggttctgaagagggagtgtgagtgtgagaggcagcaatccagaggccccagcagggctgcaaacctcacagcacccaggctgcctgagccactcctagagaatggggttggattctggcaggtgcacctggcagccctggctccaccacaggaatcactgctgtggctacgtggactctacatgcctggtgccaccttctccctctcctcctggaattgagctgtctctggaaaggctgaaagtgatgtcccgccacagagagaagggtttttccccaggcattccaggaccgggaacccaaccgcggccgcggccacagcccctcctgcgcacctgcacgatgaggggccggtcctcggggcacacctcgcagtacaggttctccttccggtagttggcgtcgcggacaaagacctgggcatgcagcatgggcgtgtagcagagctgtgccccgtggcgccggctcagcagcctccaggccagctcgctctggtccaccatgggggccacgacgtggcgggcccctcgcagggtgcggctccagaactcgaagccctgcagctttggcatcgtctccaggctgggggaaaggcgcagacccggggttcagccaggcccaacgaggggcttaagactcaactcagaggcagcggtcacccttctaaggccgctccagtaccaccgttgggtcacacgcgggggcactaaaggcgggggtcggtgcaggctggagaacggccactccagtgccgccacctcctagcggacctcgggggagccgctggacccctgggacttgaccctccctggggagcgggactcgatgtcggcctggtaggggactggcgtgaagggggaagaaaccttgacgccagcgtccccgcgggcctggccctgagcaggccgcccggcggtgaagttaggacccccggccccttcccgggagaatcggctccgcgccgggccaggggaagggcagagcttccttctccgcacccggccaggcggcccggctggcccgaaacgccacaggggcgcccctcgcgagactcctccggagccacgcggcgggcagcgtttgctgtgtgaagtgacaggagcccacacgcctccgcgtcctcaccgcgcgagggccccgccgtgtccgccgcgcgcctttggctccgagggcgccgggtgccggtgtcccgggcccgcccctctccggcctcgccgccgcccggggcccctgcagctcccggggcgccgcgaacgcccgcaccgcgccggggccgccgccgggccgcagccgggcccaaggctccgcgccgccaccggaaggtgcccggtcctgcgcggtccgggcggcccacggtgcggcgggaaacgcgttccccggaaaccgcgcccggctccgaggggaccggcgacgagaggtcgcggcgcggggtcggaggtcagaggctgaggtcaccaccgtacccgtcaggccgtggctagagaggggtcggggctcgccgggactcaccgacagctcgctggaaacgaggcatgtggaaattgggcctcgctgaggcgcacataaggcccgggccgcgggtagaccgtgggcgctgaggccctgcgctgcccagcccccaagttcgcattgggggcttcatcccgttatatcctaaagcggccccagagccctgcctcgaacccactcacctgccgcctctgaaagccactcactttccgccgctgcgttgcggaaaatcaccctccagggaccttccttgcccgccctgggtttccgcagccgccagccttcgatcgactttcctacccgccgtggaccctccttgggttatttcgagctgtggggacccactgggaaccccagagtggatgtgaaggttattttaaactgaaggcatttgagacccaacagatgtaaaaagcagctttgtcagagctttccatatctgagagcgaagcccgaagttgaaccaggacattcagtacctaaaacatgtgaaatctcttgggcccccggaatcactaaggaaaactcaggctggaagctgctcagggcaaacctgcctcccgctctattcagagtcaccctctgctcgctgagatagatggatatctgactgactcctttgaaaaggctcatcagaaggctgggcgcggtggcgcacattgagaccaggagttcgagaccagcctggccaacacggtgaaaccctgtctctactgaaaatacaaaattagccaggtgtggtggtgcgcccctgtagtcccagctactcgggaggctgaggcaggagaatcgcttgaacctgggaggcggaggttgcagtgagccgagatcaagccattgtactccagcctggcgacagagcaagactgatcaaaaaggaaaagaaaaaaaaaaaaggctaatcagaaactcaaaacaatgtaaccgtttgtgtatcacctatctgtgaccaggaagctccctccccgatggcttttgctttaaattgtcccgcctttccagactgaaccaatttttttttttgagacggagtcgctttctgacccaggctggagtgcggtggcgtgatctcggctcactgcaacctccatctcccaggttcaagcgattctcctccctcagcttcccaaataactgggattacaggcacccaccaacacacccagctaattttagtatttttagtagagatgggggtttcaccatgttggccaggctggtctcgaactcctgacatcaggtgatccgctggcctcccaaagtgctgggattacaggcgtgagccaccgcagctagccgctatgttcatcttacatatattgattgatgtctcatgtctccctaaaatgtataaaaccaagctgtgccccaaccacctcaggcacatgttgtcaggacctcctgaggctgtgccatgggcatgtcctcaaccttggcaaaataaaccttctaaattaactgagacctgtctcagattttctgcattcacagatagaacagccttggtggtcttcagaggtggccagatgtccctggtggactgcaaggttgggtgcacactaaggaaagacaggcgagggccccagctgtccaccgccctggctgaacgtgaggctttgtacaagcaaaaagtaaaagccaagtccaaattgtaaaaactacctgaattccaaatgcagccacaacccacacacagcgccatcagcagaggctggaggccctactggttcagaatatttaagcacagtatcgaaccagtaattgtaaaaggtaaaagattttttttttaagacagagtctcgctctgtcacccaggctggagggcggtggcacgatctctgctcactgcaagctccacctcccaggttcaagcgattctcctgcctcagcctcccgagtagctgggactacaggtgcccgccaccacacccggctaattttttgtatttttagtagagatggggtttcaccattagccaggatggtttcgatctcctgacctcatgatctgcccatctcgacctcctaaaatgctgggattacaggcatgagccaccacgcccagcccagatcatatgaatcttttgccttttagccgggcgcggcggctcatgcctgtaatctcagcactttgggaggccgagacgggcggatcatgaggtcaggagatcgggaccatcctggctaacatggtgaaaccccgtctccactaaaaatacgaaaaaaattagccgggcatggtggcgggcgcctatagtcccagctactcgggaggctgaggcaggagaatggcatgaacccaggaggcggagcttgcagtgagccgagatggcaccactgcactccagcctgggcgacagagcgagactccgtctcaacataaataaataaataataaaaatataacttatggtgtataacttgtaactataaagaggttataatatatagagacatataattatatgaaaaatgcagcaaaaaggaagagggaagggaattatattggagcaaagtttctgtgttttactggaattaagtattaatctgaagaagattgtgataaattacgatgcttgttgaaatccccatagtaatcataagaaaataaatacattatataggccaggcacggtggctcacgcctgtaatcccagcactttgggaggccgagacgggcggatcatgaggtcaggagatcaagaccatcttggctaacatgatgaaacgccgtctctactaaaaatacaaaacaattagccaggcgtggtggcggtcccctgtagtcccagctacttgagaggcggaggcaggagaatggcgggaacctgggaggctgagcttgcagtgagcggagactgcgccactgcactccagcctggatgacagagcgagactctgtctcaaaaaaaaaaaaaaaaaagaaaatacattatattatatataaaagaaattaaaatggtacagtggaaaatatccatttaacacaacaaaggcaatagcagaacagagaaataaaaaaatacatacgaaatacataatttttgtaaaaatacagaaattagccaggcatagggctaatttagtagaaaccccatctctactaaaagtacaaaaattagccggatgtggtggcgtgagcctgtaaccccagctactggggaggctgaggcaggagaatcgcttgaacccaggagggggaggttgcagtgagctgagatagcaccactacactccagtcagggtgacagagcaagactctgcctcaaacaaaacaaaacaaaaactaaacaaagaaaaaaaactagtggcatatgtaaatctaactgtatcaataataccattaaacggtaatgaacactccaagtaaaaggccaagattttcggagtgggttaagaaataaacaagatccaactatatgctctttacattcaatataccttatttttttattttatttatctttttgagatggagtttccctcttgttgcccaggctggagtgcaatggcgcagtcttggctcactacaacctccaactcctgggttcaagagatcctcctgcctcagcctcccaagtagctgggattacaggcacccaccactatgtctggctaatttttgtctttttagtagagatggggtttcaccatgttggccaggctgatgtcgaactcctgacctcaggttttctgcccgccttggcctcccaaagtgctgggattacaggtgtgagctacctcacctggccacaatctacacactttagactcaaagacacaaaccggttgaaagtgaaaatacgagaaaagatataccatataaacggcacccaaaagagaactggaggctgggcgcaggggctcatgcctgtaatcacagcactttgggaggctgaggctggcggatcatgaggtcaggagatcgagaccatcctggctaacacggtgaaaccccgtctctactaaaaatacaaaaaattagctgggcgtggtggtgggcgcctgtagtcccggctactcggggaggctgaggcaggagaatggcgtgaacccgggaggcggagcttgtagtgaagtaagccaagatcgtgccactgcactccagcctgggcgacagagcgagactccgtctcaaaaaaaaaagagaacgggaatggttatactaatgtcagacaaaatagatatgaagataaaatatatcactagagacacatacagactctttttctttctttctttctttctttctttctttctttctttcttttttttttttttgaggcagggtctcgctctgtcacctaggctagagtgcagtgatgtgaacatggcttcactgtagcatcaacttcctgcattcaagcagtcctcctgcctcagcctgtcaagtagctgggaccatagatacacatcaccatgtccagctaatttttttgttttttgtagaaatgagggtctcactttgtcacccagagtggtctcaaactcctgggctcaagccatcctcctacctttacctcccaaagtgctgggattacaggtgtaagccactgcacccagcccataccgatattttatgatgataaacatgtccattcattagtaagatgtaacaattagaaacacataagcaccaaacaatagagcccccaaattaataatgaaaagagtgaaaaaaaagaagggagaaatagacaatttaacaataatagttgaagatttcagtaccttactctcaataatgaaataggacaactagacaagaaactggcaaagatgtaggagatttgagaaacactatcaatcaatctgacttgacagacatttatggaacacttcacccatggctacaccatatactaggccattaaagaagacacaataaaacattttccctccagcctgggcaacagagtgagacttcatctcaaaaaaaaattaaaattaaaataattggaaagctattctctagccacagtggaattaaattagaaatcaggccacacacactggctcatgcctataatcccagcagtttgggagactgaggtgggaggattgcttgagtccaggagtttgagatcagcctgggcaatagagtgagacctcagctctacaaaaaaaaagttaaaaattagttgagtgtgttggcatgtgcttgaatcacagctacttgggaggctgagatgggaggatgttttgagcccaggaggcaggggttgcagtgagctgagattgcaccactgcactccagcctgggcaacagaatgagaccatgtctaaataaataaataagaaacaaacaaaaatagaaatttgaggtatgcacaaatacttgaaaattaataacacacttctgagtaacccatgggtcaaagaagaaaccaaaaggaaaatttaaaaatattttgaagttaatgcaaatgaaaacacatttcaaaatatgtgggatgcaataaagcagttcctaaaaggaaaattttggctgggtgcagtggctcatgtctgtaatcccagcactttgggaggctgaggcaggtgaatcacctgaggtcaggaatttgagaccagcctggccaacatggtgaaaccccgtctctactaaaaatacaaaaattagccgggtgtggtggcgggtgcctgtaatcccagctactagggaggccgaggcaggagaatcacttgaacccaggagatggaggctgcagtgagctgagatcatgccactgctttccagactgggcgacagagcgagactccatctcgaaaaaacaaaggaaagttttaactatcaacacccatgttagaaaagaaaaaagatctcaaatcaataatttatgctttttttttttttttttttttcctgagatggagttttgctcttacgctcttactgcccaagctggagtgcaatggcaggaggaggaggttgcagtgagccgacgtcgcaccactgcactccagcctgggcgacagagtgagactctgtctcaaaaaaaaaaaaaaaaaaaaaaaaaagaaagaaagaaagggcagaaatgtccctatttgcacaaactatggatacataaaaaaacatggatggttctcaaagttatgctgagtgaaacagaaaggccaatctcaagaggtatatatgattcaatttatataatgctctcggaataatagaattacaaagatgggaaacgtcaccaggcccctggcttggggtgccttccttccccatgatgggacacctgcctttggattttgccttctcacccctccaggcgatggaggtgatgggctggggggccacagccaggctgggttgaccctcggaactggccaagcttccaagaccctctctttatcatgaagtctgctttttccattaacaatataattacacctgctttttaattcttactgttttcttggatttttttttttttgagatggagtctcactctgtctcccagattggagtgcagtggcgcgatctcagctcactgcaagctcctcctcccaggttcacgccattctcctgcctcagcctcccgagtagctgggactacaggcgcctgccaccacgcctggctaattttttttttttttgtatttttagtagagacagggtttcaccgtgttctttaggatggtctcgatctcctgacttcgtgatccacccgcctcggcctcccaaagtgctgggattactggcgtgagccaccacgcccggccaaatagtattgttttagtgttctattttatatcctctattggcttcttagtgattcttcattgtattgctttgtagttgttctagggctactcaacatatatcctaagttttccaaatgtctttagaattaatatcatacaattcataccggacacttccctctttctatcatacttccagctgcagaaatgtaataaatgtatgagtatagtttccttgagccctcggtgacatacatttccttgttccttgttgacgtatattttacagctacaagagttacaaaggccaccctacaaaactttttttgtacagtggtgcagtcatggttcaccgcagccttgacctcccaggctcaagcgatcctcccatctcagcctcccaggtagctgagaccacaggcaagcaccgccatacccagctaatttaaatttttttttgtggagaagggatttcatcatgttgcccaggctggtctggaactcctgggctcaagcagtcctcctgccttggcctcccaaagtgttgggattacaggcgtgagccaccatgcccagccggatgtgatgttttgattgttttttttttttgagacagggtctggctctgttgcccaggctggagtgcagtggcatgatcttaactcactgcaacgtctacctcctggactgaagcgatcctcccacctcagcatcccaagtagctgggactacgggcacgcaccaccacacctggctaatttttgtattttttgtagagatgggtttcaccatgttgctcaggcttgtcttgaactcttgagctcaagtgatccacctgcctcgacctcccaggcgtgagccattgcacccagccaatttgatgtatgtttaactcattactgctatgattcattttgacgctcgaatcgtcctagatttggccggtgcaagcccctgcatgcagtctggctcttgtgttcacatcactgtttttgttgtttttgttttctgagcgcttcctcgttttctgtactttccctcccccaaccctggaatcaagcatgttttgtagggagccctggttttgtcagtggtagtggtgtttagagaccacgattttagtaacaggtgtcctcattactttggggctattgttattttcaggcttttttagcagaccaaatttaaaatgacgttaatacagatatgcacacatgtgcatgcgtatatcgttttaaaggcatgcgtgtactgatgactgatgccttcagttacagtccatcacctccgctatcttctctttctcccattctgtatttctcttctgtcccatttacaatacatcttctaaaaaagatcaagatttggctgggggcggtggctcatgcctgtaatcccagcactttgggaggccaaggtgggcagatcacctgaggtcaggagttcgagaccagcctgactaacatggtgaaaccccatctctactaaaaatacaaaaattagctgggcatggtggcaggcacctgtaatcccagctactcaggaggctgaggcacaagaattgcttgaacccgggagtcaaggtttgcagtgagccaaaatggcaccagtgcactccagcctaggtgacagcgagactctgtctcgaaaaaaaaaaacaacaaaaaaaaaactagatgtttttggaattctttctatctttagaacatgcccacggaaggtggttcaggttttctcttccgtgtggttaccacatcagtttaatgtgcagtttggttcatttgtttctgtttatcctcaactttagttttgtccccgtttgtagatttaattttttttcacatatataagctgagggttagggttagttttgactttccaaaacatcaaaactgtattgaaaggcatatcagagaaaggtcccttttactactatttcttcgactcctttccactcacactggacttatccttcctgtgtttctttctgcaaaaataaggacacacacacatacatactcttatttctccttatcttttttgtttgtttgttttctttttgagatggagtcttgctctgttgcccaggctggagtgcagtggtgcaatctcggctcactggaagctccacctcttgggttcaagtgattctcctgcctcagcctcctgagtggctgggattacaggtgcccgccaccacgcctggctaatttttgtatttttaatagagatgggatttcaccatgttggtcaggctggtctggaactcctgacctcatgatccacccacctcagcctcccaaagtgctgggataacaggcgtgagccaccgtgctggcctctccttattttttgtttgttatttttatattttatttcttaattctttttttttttgagatggagtctccctttgtcgcccaggctggagtgcaatggtgtgatctcggctcactgcaaccttcgccttacaggttcaagcaattctcccacctcagcctcttgagtagctgggattataggtacccgccaccatgcccgactaatttttgtattttgtagagacggggtttcaccatgttcgccaggctggtcttggactcctgacctcaggtgatccacccacctcggcctcccaaagtgctgggattacaggcatgaaccaccacccccggcccattactttttgtagagatgaggtcttgccgttttgcccaggctggtttcagacacctggtctctctttttttttttttttgagacggagtctcgctctgtcgcccaggctggagtgcagtggtgcgatcttggctcactgcaagctccacctcccgggttcacgccattctcctgcctcagcctcccgagcagctgggtctacaggcaccggccaccacgcccggctaattttttgtatttttagtagagaccgggtttcactgtgttagccaggatggtctcgatctcctgacctcgtgatccgcccgcctcggcctgccgaagtgctggcattacaggcgtgagccaccgcgcccggcctataataagtactttaatgtctttggctgctgattccaacatcagtgtccggccagggtcggttttgattgattttctctccctgtgggtcttgttttcctgcttctttggctgctaatttttcactagttgccccagggattgtgaattttacctaaatatttttgggctttgttctgggatggagtaagtttacttggaaacaatttgaggccaggcacagtggctcacacctttaatcccagcactttgggagaccaaggtgggcagatcacctgaggtcaggagtttgagaccagcctggccaacatggtgaaaccccatctctactaaaaatgcgaaaattagccgggcgtggtgacgcgtgcctataatcgtagctactcgggaggctgaggcaggagaatggcttgaacctgggaggtggaggttacagtgagctgagattgcgccaccgaactccagcctgggagacagagcaagattccgtctcaaaagaaaaaaaaaatttatgctttggggtcttgtttgtaagatttttgttttgttttaggtgtaccagcgctaactagtaaccagctaatagatcttgggccttgagacacacccatctgagtattcaatgtctcacgaattctgaggttttctagtctggttggtaggaacaggcactggtttccagacctgtgcagtatctggcactgttccgtctaatcctcctgctggtttcctgctcgcacgcattgaaggtgcttggcctggtgctcacaggagagcccccgtagcctcctgcctggcggtcccgggacagcccctgcaccccgccactgtctgccagctccccccgggtgctctgtcctgcaatcctcagcctcattttccccccggactctcagctccacttcctcaactcggggggtctgctggactccacctctcactgtgcccggcctggaagctgccaggcagaaggctgaggttaccctagggctcctggcaccttgttcccacccaggggtcaccgtccttctttggcggaggcctggtatccccacagccagcacctcctgtcctttgcctggattttcagctgtttccggtgggagggtgaatccaggcctcgctactctctggatcagaactccaattcgttacattaattttcattttaattcgaaagaaaaaataactgaagtgaagataattgtgtgacttaaggtaactgtatcttcataacaaagatacgtggtttctcttaggtctccctgaagctcatttgcaacttggatgcacctcaggcccatcagagcgcctcctcccctggcagcagctgagccaggaacttcagagacccctggacaccacattccggtaccggagagccgggagaagcaggaggggtgacaagagcccatgtgctgggcactacccgccttgccctgcagggcctgaggctgtggagctaaagcagtttagttctgaggccacccccagataggcctgtgagcctctgtcctccctggtggccctgagcctgtgtgcacggctggggtgggagtggccggaggaggggtggagagaggccagaggggaccacggctgaagggagcagctgcctagtgttgggggaccgcaggaggggtgtggctgagcctcgctccgatgcccgcctgctgtccacactcacgcctggacactgcccacctgcagccgctgcaccaggcccacccccccagcagggcccgtggtgttcactgtagtcctggcccactaccctgccctgggagatggcccctgcgcccacccctcccctgcctctccagcaggggctctcccagccccccacccacctctgtgccttggcactcacactgaaagggcctcttctgtgggcatgctgtgccttccggaaccccgggctggcctgctttgcccattcccgaaatccaatcctggctctcgctcctgcccatgcctctaccccaagctcatgtccacccagcggccccccgcacagccacccgtggggtgctgcccttatgggtcctggaggctgtgtccaccccacccctcgatgccgggggtccaggtgcccagggctccctgtcccttgctccctcccagcctccactcctttgcctaaacccaagtcttctgggtcaacctggccagccagtggcgctattgacaccgtcttggtgaggctgtgacggcatctttggcagggcgaatgcctgcaatccactgacttcaagcaaatactattctccacgaggggcctctcctcagctgaagccaacttcccagtgtctgtacctcctacacgtttctcactggtggtgtttcttggccagagcctcggtacccccccccccgccagtcccagcgctttcccgggaagcccggggctgccacgcgggctccttcctcactccccggcccagccccggctctgggacatggcctaggggtgtgtgggaactggggaccagaggacagagggcatccccttcacggccccgtgactgggtggggtggagctggagagcttgcagctgccaggtcagggaggagggaagaaaggacggtggtggagatcacatgcggtttaattgtgggaggctgagagcagcatttttaccaaattggtgtaaaaatgaaacggggtccagacgtgtacactgacagttacagtaaatttcaaaatccaagcagcaatttgaatcatttcttgaaaaacaaacacagacaaacaccaaacatggagttggtgcccggcgccgggcataagggcagcaccccacgggtggctgtgcggggggccgctgggtgtggccgggccctgtgtgcctgtgcaggggcccagctcctcggggactggcccacgaccccccactcagcgggctgagccaatgcctggccgagagggggccgcagccagcaggcttgggtggctgcccgcgcccgcaggggacatcggggaaatgggggcagagtgcgggacccacacgctgcctgaggagtcttggcagggtggacaggcctgggggtctctaccagcaatgcaataaatatgcaaatccaagcacagaaagaccaagcgcagaccccacgggcgcacgaggcccagcccagttcctgcgggcacgggcaccaccggctcttcacagaccaggagtctccaagtcggcagctctggtgtccccgaggtgccgtgggaggcggcgggtgggtgggacatgcctaacacctacatctagcagcctcggggggcagtggcactgggccggacagggtcccaccggcaggacccttcaatcccgttgcatggcgggggtggggtggggtggggtggggatggtggagtgacctccggtggcaggcgggggcacgggcctagccctcccgcacgctcacgcgtggctcagccagggagctgtggatgatgctgatgatggactccaggccgctgccctccagcagcgtgcggtggtcaccctcgatgacgtggacggatactttcccgtcgcatacctgcaggggatgcgatcagctgccgtcccaccccactcctgtccctgtccccgttcccgtcaggccccttgcgcacctgggagaggttgtagtccgcgcccaggtcctcgccgtaggcgccacccgtcttggcgcgcagtagcatcacgttgccatggtacttggccttgggtgtgtactgctcagcggcacgcagcttgtagtagaaggaccgggccgcaaagctcagctcctggcggtccaggccctggtggctcttgatgatcaggtccacggcggctgccacacgctcctctaggcccttcagcggcagcagcgcctccagcacctgtggggtcgggctctgagcaggtgctggcagcacccacagcaccggcctgccctgtgctacactgcgggtgggctttttttttttgagacgagtttcatttttgttacccaggctagatggagtggggcgatctcagctcaccgcaacctccacctacccggttcaagcgattctcctccctccgcaacctccacctacccggttcaagcgattctcctcccgagtaggtgggactataggtgagtgccaccatgcctggctaatttttgtatttttagtagagaaggggtttctccacgttggtcaggctggtctcgaactcccgacctcaggtaatctgcccgccttagcctcccaaagtgccgggattacaggcatgagcaaccgcatccggccgggatcggctattaaaggggtgaagttggggggcctttaacgctcttcgcgtcccatcccatccttcccttcccccttccgttcctgcccagtactctgggtcctgcggcctcaggggtgtccaggacccaccctgttgtgctccatgtccgtgaactgctgcacgaagaagcatatggcctccgtctcagcctcagcctcacagcctggggtcagctttgcccggtagctctgagaggaaggagggactgctgagcagatggaaggggcggggcctcctaagcgacggtcccccaaagccagggcacaggtggggagcccagacgtttgccgtaggcctctaggaccagcctggctctcacctgggtgtaggccagtacgtaggtgggcgagccgtcgaacaggaagaggctgttgtgggtgggggctgggctctgctgggcctgcagctgggagcacatttcaaaggccacgcaggccccgtaggagtagccggccacgcggtaggggccctcgggctgcacctgcctgatgcagtcgatgtagtaggcagccaggctgtggatgctgtcaaggggcgcagctgcaatggcagtgccgggcactcagcatgtgcaggcggcagccacgggccccgtgatggccagcactgaccaccgcttccagaggagggcccgggagtacctcgggtgcactgcaggccataggtggggatgctgagccgggaggccaggctgtggaacacggtggtggagccctcgattgggtgcaccaggaacaggggccgctccgagctctgcacggagttgagccgcatcagggtggggccctccgggttcaccagcagggagcgcaggttcagctgagtctgctgctgggccagaccatcctccttgggcgtggggcatgccagctctgtgaagacaggggcagatgccaggctggtctgggtgcagagccctggcacccacgcaaggacacacagacacgcacgcaggtccccacggtgctacgtcaggtgggagtcggggtgggaacgctcagaatggcacccgtgacgaagggcggtatgcctgccgggacacggtccagacaacaaggaggaagggctggggaggcccggggaccccactcccgcctggccacccacacgcaccgctggcctcatccgcctttgaggacagctcctgcagtttccggagcgtgagttgccgcacctcgcgcacggacagcaccaggttgagctcacgctccagcgtctggcgcacctccacgctcatgagcgagtccaggcccaggtccgccagtgagctgtccaggttgacagcagccaagtcgcggatgcctggaagggatgcgccgggtcggcaactccagagggggcatggggacggcctgtatgcggcagggctgacacccaggggtgcgtgggctgtgcatctcccaaagcaccaccaccacagtgacacctgcgcccgcaccctggctctgcagatggggaaactgaggcgcacaggggcacgactgctatgtcccaagaccctgatgccagcaggggaaacacctggcgcggctcctactgggagtgctcacccaggatgtgtgccacggcctccaccaggtcccgctggctgtccctgtccctataggccgcagccttctcagccagcacaaagctgctcaggaccatgtggggctggttcaggaagaggtccagcacctccaggcaggacgccatgcgctggggcagcgtgccactgacgatcgtgtcgttggtgctcatcgtctccaccaaaatgcccacgtcgccgatggcgccccactgcacggccaggcctgtgggggagggggcaggtgggcagagctgcggggaggtcggggtggggagtggccactgggagagggtggggtgggcagggctgcggggagaaggtgggggtggggagtggccactgggagagggcagggtgggcagggtcgaggggagagggtggggcccacctgggaggccttcgtgccggcgtttctcacagatacgctccatggcggaattggcaaagccgtagttgctctgtcccgcattgccacgcccgcagctcacagaggagaagaccacaaagtagtccagctcagggcacgcctctcgggtcaccctgtgggcacgcgtgtcactccccattggccagcatccccaggagcccccaacgtcccatccccaggaaacgccagagagggctgtcaacaaaccaccttggctcccacggccctgagcccagagcccggcagaggcgggagcagggctgtgcggtacccacctgtccaggttcagggtgccgctgtacttgggcttgcagacgtcctggaagaactctggggtctggttctccagcaagccatctctcaagacctgggggaggcatcctcagcactccctgcagctccagggcctcacccgtccacccagggtcccccccttggtcttggggcttttgagggccccatttggggccttccctcaccacggccaggttgaagacgccgcccacgggcccaagctgcgccgcctcggcaatgaggccccgggccccctccagtgagctgatgttgctggtggacacctgcacctgtacgccctggcgcctccaccggcggacctgcttggcctggtagcctgcgggacacaggactgtgggctggactgggccagggtacggtctcttccctacacgccgggctggggaagtggggagcagccgcagagccccatccagcaagccccccacaagatggagggggacagaccccaggcaccgtgacagcccacaatggtgggctgcagagaagggctcaggggcccggggctgtgcctggcccaggctggtccacaagcacccctgccgactcacctgtccggatcccggagcgagaagtcaacacgagcttctgcaccccacgctgtatcagccactgcgccaactccaggccgaagccacccagaccaccagcgatgatgtagctcttgtgggccgggcagaaggtcttggagatggccgacatcagcttgggtttggcccccttcagcactgcctccggctcctccgcaagcacctgcgtccaagcagcacccaccggctcaggcactgcctggggaccagagcctggggtgcccgaggcgccgggactcctcccctcacctgcacgacgactttgccaatgtgcttcccttgggccatgtagcggaaggcgtcctccacctgggccccatggaacaccgtgcacttgaggggccgtaccaccccatcccggatgccggcctgcacaagcgcccacacctcccgccagtcagcactgctctcgttgaagaacgcatccagtaggaccccgtggaatgtcacgttcttcaggaagatagccatgcctgcgggcaggggccgtgctcacccagggccttccacaggtccacccacacccatccatgcccacccccgcccaggcgctgccggcctcaccgagcgggtggttctgagaaaggtcgaatttgccaatttccaggaagcgaccgtgcgtagccaagcacctcacgctggcctgcagcttctcttccgccaaggagttcaagaccaggtcaacgcctagggggccagaggggccagacaatcacacccactgcaagcccagccaccacagtccagagggccagaccctgcttctccctgggccggaggctaggcaggaggcaggtgggggctgtgggggccactcacccttcccgcccgtgtgccacagcacatgctgctcgaaggatgtgtcccgggagttggcgaagctggtgctgtcgagctgggggaacctggcctggaggtacgcccgcttctcagccgaccctggtgaagagaggaagcgcggctggtgagccagggcggcggggccaggagggcagcgggaggcaccgggggcggggccttacccacggtggtgaagacgcggcagcccagactgagggcgatggcgatggcggcctggcccacgccgcccgagcccgagtggatgagcagcgtctccccggggcgcacccgcccacgcaccaccagcgcgtagtaggccgtgctgtagacgacaggcaccgaggccgcctcctccagcgtcctggggatgcagcaggtgggtcagcacaggcctggccgccatccacgtggggcccaggctcacaccctcgacacactcaccagttggaaggcacatcccagaggaagtccggtgacagcaggacagaggtggccaggcccttggcaggcaccagtcccatcacacgcttgccgctggcgtctcggcccgagaactccatacctagcaggctgtcctgggaggtccacttccctgggggagacggcactgagcccctcaccgcctgcccttccctcccgaggggctcccaggcaggtcctagctgctggggtctctgctccccggcccagtccactcccacggccccatgccacccatacctgggatggcatcaggggacagcttgccagtggccagcatgatgtcgcggaagttgagggaggcgtagtagaccgtgcagagctgggcgccagggcaggtgggctgggcatggcgcagcgaggagcagacccagcggatggaggacaggtccccccgggtgagggtgctcacaaaggcatgtgccgtcggctcctcaggcttgtctagggaaacagggaggtggggctgctgcggggccttcgggtgcagtctcccgggaggggcagggcagtgtcgggggctcaccctcctccagcaggaagtggcggaaagccccccaggccccgtcgcggtagacgttcatcaccaggtctccctgcaacaccttctgcagttctgcggagcccgggtccacctccgggacgtgggaggtgctgctgaggttggagagcagcacacacctgggggcagaggcggggagctcaggctggggatggggaggctggtggggaaggggaagtggtgaggggccgtgctcctaccggaggcggttcccgccgggctctcggcggagacagttcaccaagcccaccacgcccgaggtggcacagttgatggccttcagccacacaggccgggaagagtcttcgtcagccaggatgccctacagcgggtcggggagggtcaggccacactcggcaagttgggaggtggggtggggcctggaggtggggcagggcctgaccttcagagactccacccagcggaagctggtatcgtccaccggcaggaagatggggctgtcctgcggggtgggccggcggcacaggaagagcgtggagccgtagaaggacttcttcaggcccaccaggcgcagcgacaccctggagaagaggctctcccacgcgtcctgtgggggcggtggtcagcaccctgcccgcctggccctcacccggcccccaccctgtccccctgcccggcggccgcacctggctcaggatgccctggccatactgcggctcagtggaggtgaggaaggccacgatgtccccgagggggtgcccccggagcagtgtgtgcaggagcagaaagcccccttctctcagggcagccaccatgttgctgagagctgaggccgggtccccgagggcagccacagcacagttgcacaccaggaggtcggcgctgcccagggcgctgggggcagggtctgcgggatcccactggccctgggcaacgtcgtgctgctgcagctcggcctgggcagcctccagggcctgggggtggcggtcggtggccgtgtagctcagctgcagcaggggatgggggctgagcaggcctgggatgcgggaatacaggtgaccgtggccagccagcacctgtagggggtgaattctggaatcagccccacaccaggcaggtgcccctgacctggggctgggcaaaatgtccatgaggcctcagtctggcagaaaggcttccccgtcaacctgatgacggtgccagccatgggcacgcatggatgccactggtcttgtccctggggtcctgcctaggctgcacctcttggagcccacgggcggaccctccacggtggctgtgtggaccgcacaggacacgtgcacagaaccacacagggaactggccggccccacccaccgcccagggcccgccccgtgtctgtgctgtctcctgcaactgatgtcagggtgggtcctaccatgtccggggcagaggcctggctgcccaggaggcacccacctccaccaccttcatcttcaggctgggcatgttctccacggcagtgtccaggcaggccttgagtgccggggagtccaggaggccgctgagcagagggtcctctggcagcttgggcctctcctgggccagcacctgcgccagctccagctgcaggttcccgttgagctgaagcctgcaggcagccgacaacagccggggcagttcctgctgtgaggggtcccgggggatctgggccccatccagtccgggcaccaccatcttcagcccctgctgggtcaccttggtctgcagtgcctgcaccagccctggggagggagggaggcaggcctggtgttcccaaagccccagggcatctgcctggcatgggctctcagacccactctgtccttctggggccaccaccccgctctgcccacaggatgagaaatagctgagggttgaggaaggggctgcccaccactgggaggctgactcctgcccactgtggacgcagtgaggggccgcattcagctgcaggggctactctgtgcctagccaaggtgtgaccttaggctgaatctgtcatctttgcccccaagtaccctttcaagactgaggaacagtgaccagggacgaggaaggctgggggctgggggagggagggaggccgccatcgtgagctccggccggagggttgggctagggttgctgaccccaaagggggccccgtggagaagcaagtctggggtcaacgtgaggggaggcgatcgctcctcatcgccagaggtgtccgaagccagcagggctgggacctcacccttgcacagttgcagctcctcctgcagggcagcgcgctcagacaggcacccctcctccgtgtggggagtgaagcaaaacttctccaggatgggcacctgctgctcctgctgccgccgcggggccgactcagtgtggagcccggagatgtggacgcctccggccactgtgaccctcagccacctgctcaccaccacgtcagccactgtggggacaggctgggtgagtgcggcatacttgggtgggggcactgggctggggctggggcggggctaccttgggccttgtcctgcagtgtgtacagcttctgcctgtgggtggcagggtcgatgtggatggcggtgacacgggtgggcaggtacaggccgtgcttggccgagcccaggatggacatctgcagcatggtgtccatgaagctcacccagttatccttccacagcagcctccccgagtcacctgcacacagggcctggttggtgctgtggaactcccaggtccctggggccacctcccagagcccaccgggcccctctgctccctcccaagctgcatgcctagctgtgggtgccctctgtggtccccacaatgacgaccgccctccccggtggcttgggcagcagtgtagtcagtacccaccttccaggctggcctccaggatgccctggaaatgagggccgtagtcgtagccacgcagacgcagctccttgtaaacttcagcctgggccaggaagaggggctccgtggggttgggggtggggctttccgggtggtcgaagagcctggggtcagggtcatcccactggtacaccttccctgtggaaagggaggtgcggaagggcctgaggacgggcggcatggccagcgggcacagcctccgcagctcccgtgccaccggccctgcttaccactcactaccaggttgccgttctctgacacctcgaaggcacgggaggcctccaggagccgtacctccagggacactgtccctgcagagcgggagagttggagatcagagggcagcacccgccccccagctacccccgccttggtcctggggtacccctcaccagtcttgggcaggatggtggcctggtgcagcaccacatcctcaaacaccacaggcagctgctcgacgcccaggcccagggcgcgggccagcgtcttccacactatgctcaggtagccagtggcggggaagaggacgcgaccgtcgagggtgtggtccaccaggtagtggtcaggagactcggagctggtgtctgcgggagggcacaggcctcagcacagagcgggcgtctgtggggagggaagagtctgcccacccgccgggcccctgctcaccgatgttgtagatggcggctgagggggaacctgaaccgttggggaagtcctcggcggccggcacgtcccaggccaggctgtggtcccacttgatgagtggggagatgaggggagttcctcggggagctgggaactccacaggtgggaacaaggcattggggttggcgtcgatgctacggagaagggaggcatgggtagcacacccgtcaccggggtccaggggctctgggttcagcccacccactgcctgcggtggaccatccagggctgctgccaccggcctgggtcagtgaggggcccgcagccccgctcacccaccccacgccgtccccgactccgggagacgagacccgggctgggaagggacccaccctgagaggtgcagcctgccgatgccggccaggaagaactccaggttgtccctgtgatccttcttcatcagggggatgatggtgcagctcggcttcaggccacgcttcaggacagcctgggggcggcagggcaggtgggctctcttggtgctcagctgaggcgcccatcccaggctcccggcgcctgctgcccccaggctgggcctacctgcagcagggcgtggggcgcgatctccagcaccaccgcgtgctcaggcacgtgccacagggcctcctggaacagcacagggctcaccaggttgttgacattgtactcggcggaggacgtgcgtgccaggctgctgtgccactgggcctcggggatagaggtgctgagccagcgggctgaacgtggcttcggctcccggatcacctgcatgaggggccaggtcagtgctgggttgtgggtcccctggcccgccccgcaccccccaggccgtattagtccaccttcttgagctcctgcagcagtgggggtgcgatggcctccatgaagtaggagtggaaggccataccgccggtccgcacctccttggcaaacacaccctccttcctcagctgctccacgaactcaaacaccggggcctggacatcgtgggagcctggataagcatcctggctgggcacccacctcaggctcggagaggtagggcgcacccacctcaccccaagggaaccgagagggaatgggcaagggacctgaggacaaacctgccccatgccccaggcccgtcagagcttggtggggcgtagaccgtggccgcgtgtccctgccagacttgcaatggcaggcgcaggggacagaggagcccgcccaggccgcagcacccacctgaggtcccgagatggtgactgtgtccttggagttgtggcaggcgggcaccacgcccggggggcagcgctgtttacactcctcccaggacaagcctatggcagagccagcctcagaggcttagcgtggacaccgagccgctcccagccacccacccacccagacactgcctgcagctgggggcagtaatgacaagtgtggtaatggcagccttggagccttcatgagaaaggttcgccccctgctgtgtttgacccgtgggtggaggtgtcattacagagctgccactccaggggcagctcctgggagcccagtccccagatggtggccccctcagtcctctgcagccaaggttctttccaggtcctgcccacatgtggcccatggggctcagagatgggtgccaacagagggcaccagtctgagggaaccctgatgacccgtgtgttggcttcaccagagcccctgggttcttgctatgctgcagctgtgtgctcatcacacgggggctccacgcaggcctgatgcccatggacacgtgcctaggcccaaggctgccaggtgtggggccagtggggcagctgcaggggactcgcgcacggctgtgtccgagctgggtgtccccgggccagcgggggccactctatcctacgggggccaggccagggctgcaggtgaggaccccacagcgagaaggcagcctcctttcttggaggtgctgggggcccctccgggagacctacccacggctgccatggcgcccggcgggagatgggcttctttgatgcactgtcccctccagtaggcagcgaggacggcctcctcctgggacaggcagccgtcggcgtagccacaggccacctcccccagggagtggccgacgatgccatctggcctcagccccatgcagctcagcaggtctatgaggcctatctggggtgggaacaggacactcaggttgcaacctccagcaggtgcagctgttgggggcggcccccggccccactaggccatctccacccccgcgccccatcgaccctcccaggtctcctgataggaaagaagcccctatggcccccacacagccccactgagacccctcctcccctcccgtcctgcccccagcacaaggctctgcctagcaaaggggctgtcaggggccccggactcaacactgcagctcctgggctccagggaaagccagagccctggggctggcgttgctcacacgctggcaggctgggccctacctggatggcagtcaggctcacaaacgaatggacgatgtcatcaaaggtgctctcgtctgtgctcagcagcagctgtgacaccttcaggccgaatggcttcacagcctcatcggagcgtaggatggaatctcggaagcggtccaggcgcatgaggctcagccccatcccgcgccactgtgtgcccatccctgtcccagagagcacgtcacgaggctcagccccatcccgtgccactgtgtgcccatccccgtcccagagagcacctcaggggaccaccagctccagttcgcctgcctttccccagggaagggaccaccttgggggcagagtgtgggctcaccagagcagatgaaccagagcgggcgctcgccagcgggcacctgctgcacctctgggccaccgcgctcaccacccagcacagcgtagccacggaagggcatggcggtggcggggacagccgcgatgtcgttcagcatgctcaggaaagccaggtcctggctgtgccggaggccctgctccagcagcttctgcacggcctcaggggtgcgtccgctggcccgcagcagacggggcagggtggcatgtggggcgggtgcggggggcggctgcgtgttgggcctcaggatgatgtgcacgttggagcccccgaagccaaaggagttgatgcccacgttgccgccacggacgggcaggggctggtccaccacctgcagccgcccatccaacagcgctgggatctcagggttggggctatggaagtgcaggttgggggcccagagcccgtgctccagggacagcagcacctgcgggggtacgtggtggatgggcagccgccccactccctctaccactgcctgagctgggggcaggcacctccccgagactctcatgtggggccagggttccagggccctctccgatgcacttcctgtccccaacctaattctgccatggcacaggggtccgaggactgagccgccatggccctgccctcagcttggtccaagacctccccttccggccttgctgcctcccagcctgatgtggacccaccaaagcctggctgtggcctgaacactaaggcccccttggcccagatgttgcatctcagaggctgcagaagttggggggcagagggcgtgagtgatcatgggtgttggggctcctgtgcctggtctctctaaaggtccccaggcctctgctagtgggtcaggaagctgtagggacgggtgggcgacacgggagaccctgatggtgccgtggacccccccaggcctgctcctgcctcgctcttcccacccaagcggctcctccagctcggctccgtgtccggcagacgctctgcagggcatcaggcctccagggaaggcccagcgagcctggctacgagctctccctgctgtcagcctcagtgcctctgctcagacctgcagcatagcccgggggacagaggctcctggtggggaagcccccgcctccacttggcaaagagaaagcagcagtgcccagccatggcgcaacccagtcccagggagcaggagcctgagggacccccaagcccagccccacctaccttggccagggctgccagccccgaggctggctccgggtgccccatgttggacttggtggagccgatgagcagcggctcctggcgggtggcgcacagggctcgggtgatgccattcagctcctgggggtcgcccacctgtgggaaacatggggggtgaggggctctggccaggtcacctctccaggcatgggcgtaggttaggctcatggggtggtgagtggggcggggggggggggcatcaccttggtgcctgtgccgtgggcttcgatgtattcaaatgactcaggggccactccggccgactggtacaacgagcggatgagctgctcctggatatcccctgaggggaaggtcacgcctgcggagggctcggctcagtgctgcagccccagccccggctcccacctgccccccagcaccccggaaccccggcagagcccaccttgctccttgaagccatctgtattggtgccggcgttcaggatggtggcgtacacccgccgggccagggacttcttggtcagcaggacggccaccacaccctccgagcggcagtacccattccctgggtagagcagcacctcaggcccggggctcagccccacgccggcccccaccccaccaggaggagctctggggtgtggggtgggtgcttgggtgggggatccccggagctggcaggatcctgctcagcgtggggactgtgcggggggccgtcctgtgccactgtcccgcctgccctggccgcgcagccgcacactcacccgctgtgtcgaaggccttgcaggtgccctcggggctgagcatccccagcctcaagaactgcacggaggtgttgggcttcagcaggacattgatgccccccacgatggcggcagggcactgcccgctgtggatggcctggtaggcgttctgcagggccatcaggctggaggagcaggctgtgtccagtgcgatgctgggccctgcaaggaagggtgctgcggctcaggtggggctgtgagcacacgagacccctgagcacacctcctgccaccaggctggacacacactgcacggagtgagcccacgccacgtggtttctgctcagcatgtggggacctgaaggccacccacctccgcaggaggctgggcaggacccacctctgaagtcgaagaagaaggagagccggttggccatcatcgctcgctggcagcccaccatgctgtagcccacgagtgtctcggggtctcggctcagggcctccgaggtctcagagccgctcacgcccacccagacgccagtgtgtgttcctcggagtgaatctgggttgatgcctgccacaaacagtggtcaaggtgccacggccgggccccacagcgcagccagcccacccacccacccggctctggggcgaaggtcccatcttggcctcactggcttggggtgagggggggtccatcccagtgggaccctggaaggggcctaaggagggtgaggtgtcctgcagaggggccagaacagagcctgtggccagcagccagcccaggtgaggcctggaacaggaaccaggtcacagagggaacgaggcggagggggcaggcgggcccaggggagggcaccaggcacggccagagtggctccaggaaggacagagggcagcattgtccccaggcgacgcctttggcccctggtgtcaccggcagctctgatgagcccgtcggccagtggcctctccagcgccaagggcagcctgcaccagaacaggccgtgataaggaaccgaggagacaaaggccaagtgtccaggctcgggaaggagagagggacaccggtcacccccggggagcataaccttagtcttggggtggggtctggcagcaggaagggcgcaggagaagggcttccacctctcggccagcagggcccctcctcgcccctggtgggctggctctgccctagggtgggtgggtgtgtgaaccgctcacacccaagggcagcccagggctcagcctccccctcaggaggtccttctccgcccggggagggagcacctggatcttaagaaatggcatggctgggcgtggtggctcatgcctgtaatcccagcactttgggaagctgagatggatggatcacgaggtcaagagatcgagaccatcctggcaaacatggtgaaaccccatctctactaaaaatacaaaaattagccgggcgtggtggtgggcgcctgtagtcccggccactcaggagactgaggcaggagaatggtgtgaacccaggaggcagagcttgcagtgagctgagatcgcgccactgcactccaacctggtgacagagtgagactccgtcttaaaaataaataaataaataaaaataaaaataaaaaaacggcgtggcgcttgtccgaggtcaaatgccagtcagagcgagggccaggctggcgggagagggttgaaatgcctggggtggggggacgtgggcaagggtagtggggagggtgggaggggagagacagcagggccggtgctgtccgctgcttggctggtgggggtgggggcctggagggcccctcaagaacctcctgctttgcctctcgtcactccagccccggccccggccccagcaccagccagacatcagaagcgaggagactggtacgctcaggtcagggcacacccgcgacacctctggggtgcagttgggaaactgcggcctaccccgtggcccacacctccctgagcccgttggccaggccaggggcacagccggggagggtaggtggtgccagcacctggttctaccagaaccaagaagagaaaacactgcctattccacgtgagcagcaggagccctcggcgcagcagtcgcgaatgcccgacccacctccgtccacgatggcttcataggtgacttccagcagcagccgcagctgagggtccatcgtgtgtgcctgcttggggtggactccgaagaaggaggcatcaaacctagacaggtccttcagcttgccggaccgccggggcaggccgtagagccctgtgggacaggcgggtgtttaaatctctgacggaagctgcccagaggtgggggccctgtggggtgctgcaggcccctggaggggccatggtggaactgaggactctctgctatgcctgggaggcccaaacaatggagcaggctccccaggaggggaagaccatggccccaaagcggggactggtacgaccagatctgctgcacaagccccaagccccaagccccaatcctgagatgggccgcagagcagagagctcggcgggagtgaggctgggggaccatctgccgggctggtgcctcggctctaccatgctgactcacagcttgcctgtcaggtagagctgctctgtggaagagcctactgggtgtggggcagttgctccagcctcccggagcacatctggtatgcaacctcccagctcaggacagacacaggcaggggcagcctggccggaagggctctggccccccgcaccccctgcatgggtgagagaccccagcccgtcacccatcctctgagcttggctcctccgtaacaagcagatgggccctgcctgggccagccctcggccttgcagccattgggggagcctcctgttggccttgcagccgttgagggaacctcctggcaggctgggcgcattttctaggccactctggtgcaatgtccaggaaggaggctgcagctaggcctcgcccatgggtgaccagtggctctgcagctgggaccggcctcaggccagtgcctgggtggtgaggacacagcacagcagggaggctgctgtgaggacaaaggtggagatggagcttcacaccccaggcacggggagccccgcagccacatacccgccttccagcgacggtcatcgtccgtgaccatgtccacaccgccgatgaggttgtcccagaactcctgcaagttctccgactctggcagcttcccggacatgccggcaatcaccacctcctccatggctgctctgcagggcgggcggtgtgagtgccccacacatcccggccacgacacccccgtcaacagcctcggcacccagaacaggtggacacccatggggccaagcaccaccctgagggtccgtgcgggccctggctcctgcggctcccttcctcatgtggccagttcctgggccctgaccccgctctcgctgggaggggctgcgtgctctgggaacaggcccgcctctgggccctgacccattcagttcagggtattggctggggtaccccactggagccctgcagccctggcctccccagcagttactggtttctgcgcctgtgtcggcttccactcgcctgagtctcagccttccaaggctcctggagcttgtcccaggccatccctagggcaccagggggctcacagtgaggagcaggcagggtcacctgagatggggacaaggcctcaggtggccagcctgctaagggccatcaaagaaatggagaggcagggtcccaaagccggggcatggaggtggctgggagccctagaggggggtactcagcacccatgctcacccgtgttggggtgggggcccgctgtccaggccagcccaagagccaccagggctggggagggacgaaatggggatagcctatgctctgggggaaaggtggcccctgccccactgtggaccgacccagccagtccaacccctccagcagggtccaacctggagaaccactcctggccaggacacgcaggtgttgcctggcacccttcacctgcgcgggtgaacccacagacgcttgcctccccataccaacccacacaccacaggaggccctccctggagcccaggtccctaagacccggaacgggtgcccaggccgccggctcctcctccagcatgagggctggtgcggccctggggggagggggcggaggccagcgctggtctggccacttgcacgaggccccagggcctgatacgcgcgccgcccctcggcagtgcggcctcccttgggccgtcccggcagggaggcggccgccttcccacccgctgcgattcacagaggcttggctgccccgggccagctccaggcccgcacgctgggtcctcgccgcttgctattcacgcggggtcgacggccaggcagggggtgggaacaccgcggcgcgcccggcctcccttcgccccgggcgggggctgctcgggacccctgcgcttcggccgggctgcgccacgtgatggggaggccggtcccggcgcggcccctgcgcccccccgttcctccctcgcggcgtccccttcgggctgggcctcggctccggggcggctccgggaggaggatgcggcggcgcctttgtgggcgcggggaggccgagccgggggctcctccaggcccttcagggtccgcggcctcccccacgggaagcgaaggcggctgttggtggctttccccggcgtccttcccccgccatccgcccacctactccgcggggccccgggcgcctccgaaggggcacgaacaccgagacccggacaggccgcccaggcgacccctggatacggggccgggccacgcgcgccccgagagcggaggatgaggagccgggccaccccgggaaccccgggcccagccccgaccacgacccgcgccccggccccagcgccggctgctcgtacctggtgagggcgcgggcggcggtgcgggcggcggagagcgaggctggagcgcggcggagcgggaggctgaagcgcggcggagagggaggccggggccgctgccgtctctctggctccctctaggccggcgccgacgctatttaaaccgcggccatccccgggcggccacgccacatgggctgacagcttggctgcgccgcccaggccaatgagcgtcggggctgcgccccgggacccggcgcgccgccgccggtggggtgatgctcgtgcgcgccgccgcccgagccgggaccctgcgcgggaacgcgcctgggggggtggggctgggactgaggagcgccgggggcggggcgggcgggaaaccaccgccccccgacttccgcctcccgccccgcgggccccgacgcgcacgcggctgcgaccgagcccgcggcgcgcctcccgagccatccccgacccccgtgtccgccggggccacgtgtgcgggatgggaatgcttgggccacactggggactaccccgtggccacaccgggggtccagccggctgcggcggggcgctcggacccacaggcgcgcggaaggacggacggacccgcgtgcccgcacttcggccgccgactccacgccgccgtcgctgcccgcgcggagctggctgagggcgcggcgttgcgcggcgcggcggcagcagcaaccaatcgggcgccaggggtgttcgcaccggcccaatggcggcgcgcgggtgggcgttgctaggcgatagggtgatgggcgggcggcggggcggtcccggatgcctcgcgggccgcggcgcaagtgcgggcgttgaccccggccgcgggcgccccggccggggttactgccggtcatcgcagcgcatccccggttttcctcgcgggtgcggcggggaacccagacccgagacggacgtccacccacccgacggcccctccttagcagcttcccggggacccggacgaggcgcagggccgaacgggcgagcgcactccaggccgctggagctcggcggaggggaggggcgcggccacgtggcgagcggagtcggccgggacacccacctggtgtggtgcggacaaagggagccgctgccccacttcccagggcggaggctgcgagttttccaggcgcgcacccacgggcgggggctcagcccggccctcgcgcgctccctccctcccgagtgattcctcgaatcgtggccccttgggcggcctgagccctgaagcgcggcctcccttttctgaccgcttcgcgcttgcggggccaggcaccccatggggggcaagcgggccttgtgaggccacaggtgtctctggctgcgtgtcctactttgagggctcagcaagcccgggccgctgaaggggaaccggagactggggcccccggcccctctgcaggtgtcccgcttccttcctctcctgagagcaggcctgagggtcaggcggccactccgcgtcttttcccttctggggctgtggttgacgcacggtgggaccgagggtcaaggaaggacaagggaagacagggccggggctggccccgcactgctgtccccactgcgggggttcttctgattcagggtgaggccctgtgtcagcctcaggcgtgcgggcacgcagctccggctctccatgctccaaacctcccaggtggccctggctgccagtgctggtgatcagcggccagcggggccctgctctctgcagcctgtcgagggctgggccagctacaggggagccctggctggctcccaaggaggttggagactcgtccagcaccctgagggcttccacagaaagtgagcggcagcggccgggcttggtggctcacgcctgtaatcccagcactttgggaggccaaggcgggcaaatcacgaggtcaagagttgtagacaagcctgggaaacagggaaactccgtctctactaaaaatacaaacattagccgggtgtggtggcgcgtgcctctagtcccagctactcgggaggctgaggctggagaatagcttgaacccaggaggcagaggttgcagtgagccgagattgcaccactgcattccagcctgggcgacagagcaagactctgtctcaaaaaaagaaacaaacaaaaaaacctcacagggccgtgactcgattccaggggacatgtgtgggagaccacagagcactgagagcctccagcccatccccaactccgtctggattcccatggagcaagtgacggaggctaacctcaaacgcccctgccctggggccacagcctttgtctgtgtggtgtggtctctgcttgtcacggttatccggcccgcacacctgtgagctaggccagccgatggcactgtctatattttacactgggggtgcaaaccaaagctgcaaaggtcccacgatttgccaaggtggcacggcaggttagggctgggagcagcgttctcccatcgtgttcccagagaagctgtctgcccagttcagaaaggtggcccgagggtatatggcaaggcccgtcaattcacccagctgggtaccggctgcctccacccctgcactctgctgtgggcagagtgtgaccaggcctggggggtgcgggggacagagactgggctcctgaggagtgggggtgggatatgaaccccccccagtcaccatcctgccggtcgcagagcactgcgtccgtgtgatgaacccccaccccagtcaccgtcctgtcggttgcagagcactgcgtccgtgtgatgaaccacccccagtcaccctcctgccggtcgcagagcattgtgttcgtgtggaggacacgcgaggactcttggaagtgctttttggcggggtagtgcagtgtgttccgggcggacgggcgtcagtttacgtgtgcgtttctcatccttgcaggtacctggccccgggcactcaggtggcagggacattttgctgttatccttcgtgggggtggacgtggaaggcccagcagtgaccgctgtccccggttggcccccaccctgccagcacctgacatgcacaccccaacctgcatgaggcccaggtgcccacctggcttccaggggtcaccttggcccggttcactgggatccaaggctctcactccttctgggagggcccctcccatggtactctcaggagacgcctgctttgtgggtgggctttctgatctgccccctacctgctaccaggctctgaggaaggccacactgtccccaacaccactggtgtgcagatggctgtgggtggtgacacgggcaggccaggctctggcacaggcacttgatactgcatttcccaagtaggacagataaacaacgctaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggcctttgcctgggctgctgtcttcatccctggggtggcaatgcctgcctgcatcttgacgggcctcctgtcggctgctggaggagctgggagctctgtcaggtaaagaggaaaaaacagcatgcatcaggatggcagggggagcaggaggctgtgctcacaggcactgcacaggtgcagcacttccgtgttcccggccagcgggggccctgtgacccttggcctggctttcctccaggagtccgtgaaggccaaaggatcctggagtgaccagagagctgtggcctcgccttgctcagtgggtcctgcttggcagggactgggcctgcccctccactgggcacctggacatgtggctctgaaaatggtcctgttgtgaccatttcgtaatgggtcccaggagggggcaggggtgctgtgtggtaatgggtcccaggagggggcaggggtgctggggtaaatggttgactcaaagctcctccccccaggctgccccgggtgtccctaccatctgagacacattgcctgcccccgcctccccgatgggccagcagtgccaggcttttgaggccaaaggaaaggccgtgctggtgggcaccacgtggccaggcacaggccaagggcccaggagtgcgctacacacagaggctggggcctaaatgccagatagcccttcctaaacatcggctaaaaccatcttcgcagaggggtgttgtaggtgatcttctttatctggccagtttttctctatttttcattttttcaattaagaatgtgggggttttttttggtaaaacaacagcaaaatgttactaaaaatccatgcaagggctgggcttggtggctcacgtctgtaatcccagcactttgggaggccgaggtgggtggatcacctcatgtcaggagttcaagactagcctggccaacaatggtgaaacgccgtctctactaaaaatacaaaaaattagccgggcacggtggcgggcacctgtaatcccagctacttaggaggctgaggcagcggagtcgcttgaacccgggaggcagaggttgcagtgagccgagattgcgccactgcactccagcctgggcggacaagggcaaactctatctcaaaaaaaaaaaaaacaaaaaaaaccccacagtaagatgtgagctcagcgtccactgcgtggccacactgtggctggggtgaggtctagaggactccagcacgtggctgaatgtggcccagtgggcagtctggacaggctgacccaggcaggtcagcgggcggccaacgcctcctgctggagcccagcctgtgtggtctgcgtgcagcctgggtgactgggaagcgtctgtgctttggggacaccggcaatgacgcactctcagctgggctgcgcagtgcccatgggggcagccacacactcccagccctggccctgggcccctcttcccatctcagcttcttccactccgatccactcttggggtctcaagacacccggaaccagtcttccttttcctgcagccccgttggggtcacacagtccctggccccctgctggggtcctggggggccctggacgctgcctgctccctttgtttccaacccccagaggaattcctcctcttcacacaaaggctaccaccctttatctctcaacaataagcctgcctgacctcctggtcccggccaacgcccccatccccactccctccccccaccccccacactggctggcagagggtggggtatcccgtggaaagggcttcctgcggggaagctggtcctctgaccaggccctagtgctccactgtgaccctgaggcatctcctcaaacccagaggccttggttgtccctctgtaatgctcagggattctgggggctttgcccggcttgatcctcctcagacaaagcctgtggggattttcagaaaaagtgagctgagggaggggggtgaagggcctgcccctttgcctgggaggcctgagctggccctgctgggaggaccctggctgtatcccggggcgaagcagggaggtgtgagtgggtcacagtccccggggcagggaggggcagggaggggcagggagggtgagctggccccctccccagggcaggccggcccctagctcagaatatccactttacaggctctggtttcttcactggtccttttcctgcggagccctcctcagtgatggtggcagggaactggccatgagcccaggaccccagggcagcggacagccccagcccagccagtcctaggtcagaggcacggagctggatgtgtcaaggcggctgccccaggcgtgactccctgtgaccccggattcttctacctgatgctaatctgaggtcaacccagtaactggtgtgtaaaaacgctcttggcctccaccactctctgccccgccttctcgcctgacctgttttgccgagcctggccgggatttctctttctgcgttgggctgactgggccgcagggaaaccatgtggacacacagtttgccgggcacagcgtgaggaacgcgcctcttgggtcctgcacccctcccccacgggctgcttgtgctctggccccgaactgagcttctggaaagttcctgaaacatccaaggccttgcagtgattaaccaggggagggggactggggcctgcttgcccctcccaggcttaacccctcccaggtcctggtgtgtgctgaggcagggccacccaggctgggctccgtcccctcaggcggctgcaccatacttggagggttttttaaatttttatttttatttttgagacggagtctcactctgtcgcccaggctggagtgcagtggcgtgatctcagctcactgcaagctccgcctcccgggttcacgccattctcctgcctcagcctcccgagtagatgggactacaggcgcccgccaccacgccccgctaagttttttgtatttttaatagagacggggtttcaccatgttaaccaggatggtctcgatctcctgacctcgtgatccacccacctcggcctcccaaagtgctgggattacaggtgtgggccaccaagcccggcttggaggtttgaagctggtggaatctcagggaggacatagcctgtcctattgcagggaaggtgcggccctcactcccgtctcagcctgggggcatgagaactctgagcacaaagaggacggagctggtccccagctttctggccaccctgtgagtttcttctcctgcacctgagcctcagctcagctcttgaccaagttggcctctggtggctcattctccaggctgctccgggctctctgggtgcccctgggcacacctacgtggcttcctagggctttgggaagggccagacggtgagcccacgccttccctggttctccagagcctgccttggggctggggagggcctggccctgatggcagctcaggcctcaagtccattctgtggcacagaggcccttccgtctccctgtggcctccgctgctctgtgtggttcacccctgctgtgtcaagggcccttgttctgctgaaccccctctggctgccacaggggtcctcacgcacccaagatcaacccttctcaaatgcatctagttatttccaagtctcttgggaacaaggcttttcccaccactgtcagcacggcacccaggcctttagtgcagacggtgacagtgaatgtgacttgactccccccaccccgaatctccagaagctgcgtgcacctttccagggtccccacgcctgggaggctcacaggccacgcccacccgtgtctccccagcctgcgtcaaccctcacctgctaaagtctcctaatggacacccccacccctgagctcctggagctcagccctggggggtcaccgtggccccggggctgcctttgtgggactgagtgtgacaacaggagagcaatggggtacagggggagggaggcccacgtgatctggttcccacggtccctccacagggggacactccgggcctgctatgtccagctgccttccccacctcactggcacatggagcctggagcccccactgggcagatgcacaagaggggagggtactggacattgcatgctccagggctctgggcagtcctgccacccatcactcagcctggtgaggcagggccagcaggaaaccccagatccttcaggccccgcctgctggcctttggagcagaggagaggtgggccctcgggggcctgggcgccgaccacaggctgaccccttgtttcatgccagcacctcctctgggcgcctgtggctactcccccaacggcactggcaggtcccctgctgctgctgagcctgcccaggcctgtctgctacagcctgtcagtgttgcccaatgtgggccccatcccagcccttgagaggagtcacctagtagtggggtgcaagctggagccccaaggaagggaattcaagggaaacacatcgtgggcataaggctttgagagacgtgggtctgtccctaccggaggctgcatcacggaaggcgggcacacaggcctcacttgggcgagaagagacccagagacgcatggccttcctcctgggccggctcccgaccagagcccatctgagctcagcccacaggaaggggaggtgccaagaaccccaagcacaggtggctgcaggctggtgggtgccgaggaggccactaggaggctgagacggtgagagccagggccaggcagtggcctgagagctggacagcctctgggtatctccacaccccacccttctcctgcctttcagaagagtaaacgcaggagaacgccctgaggccccggaaggaaagtgacaggcagcggctgagctggggcgacaggaagtggcagctgtctccgctgtttcggaggcatgggaactgtttcctggtcctaaagtgaggaatgctggcctcatgccccttgggccaggactctgcactgagtgctgagtgcctgggctggtgtttagacgactcgtggtctctgttggcactgtctggggacagcaaaaagcagcaggggccagtgtgcaggggagattctgggtaaaattcatgaaaagggaactttcaaaaggggcccatggggccttcccaggtctgccaggccagcttacagctccaggtgggcaccctagcatctcagggccatagaccagcaggtcaccgccatgtccccggggaacagcactgcctgccactcactttgcctgagacccgtgtctcagggctgctccctgcatgtcttggcaggagggcggacagctgggaaggaggccacacgctcctccagggagcctggctctgcaggagctacgccagccacacacttatcagctgcccgacctgctcaggacactgagggccacatgcctggccaaaggcctctccccactccctcttctcccctggagaccaggcccctggagttgctctccagagatctgggcaatgaccctctggatcccagggtttttggttcccctgggaaaagaggcaaaggcccacacacctgcagcaggttgggggtggggggatgcatggcacagtggcttggcacccgggtggggcacagatgccgcgggagtggggagtggggagtggctgcctcgaaccctgctgtgtggcttgtcaccctccatggcgtctctgcgcctccgtttgactccagctgcacggcacacggggcgaggttagcatcaggggccaaagcggacccccgccagaaaggaggaagaggcccccaggtaggtgcgtgcttctggacctggcgctcggcacactgtgaggatgggcggatggagttggtctgcaggttccagaatgaatggggccctgttgtgacaggagaaggagggcagcctgggttgaagaaacaccccctgctgtccaacagctgcactgcccgctcccctggcaacacctgccacgtggactggagaagacacattagcccttgggctggaagtcgtggaccggcgtccacctgagatgggactctgggagggaacagccgccggccctcctgcctcagctgctctcagcatcctacagtgccatcgggtgctctcaggacagatgcctacagaacaggcttttctaaagaaagggggtgggctccagggcccagagtcacggcacggacgagggggctttggatcactctgcacacacctcaggatggaagtcctggtcagcaaatgcatgagcatttctggtggacccacctgctcctggggcaggctggtctctatccccattcccaatcccacgtgcctccttgcctctgtccacgtgatgttggagcagcaagccttctccaagctcagagtcagaggccacaggccactgtccccttggccaggccgcagtccttgactctggagcactcggagagcaagtggcagagacgagtgacctgcggccgctctggcgctctgcctcctagtgagatgagtgtcatggcttgcccgggtcctggagttgtgctgagagagcacctgacctgtgatcccacccctgaaaacgggctcctctgtggacagccgggctgttcttgctcctcgaaggagtcccccagcccctcaggaaagaggttcggccctggtcacagactgggcataaaatctgcatatttatagcagggtccgccgaaagcctaaaacaacagtgagtttcagggcaggatctctcttgcttgtgttgcattggtgtcatgttatcgctggctctgagttttaaagggaaatacacagggtagtgcatgtgacggtgtccaagacgcacagcagattttcattcacaaaaaaatctgaccacaagagctaaacggaaataccttccgctgtccttcccaagtcacagagcaaacacctcagttcccaggggtccgcatcagttctggtggaggcggtgactgtgagcgtgaccagctgggctaattcgtcctgacatttagttgggacagctatagtttcctacctctatgaccagagagtgaagcgtttcactgaagaactgtggccggcgtctccaggaaaggaaggagcctcgctttctccagggcaggggcagcgtggggcggggcaggccgggtgtgtctgtggggagtgggcgcgtgctcacactctttaagctgcgactgcttcctttaggacagaatgaagttcttcgaggaggccgatgaagacagaatatggataaggccaaacctacacaaaatccttctacatcttcatatcaaaacatgttaaacataaacctccaaatacctacagggatacaagcacagggcttcctaaacaggcgggatatgcagcctcgttctatcccaggcccacacagaaagtgttgggggagtcactgaaggaaggaggagaaagagctcagaagaagccataagagagcaagacatggacaggaaaccaagtggccccagcgccccgcaggagagctcagactccagggctggggtggcgcagagcggggcgtgtggagcgcatgcctgcgaggggcctacgaggcggctgcgaggcataaggttctgtgagcccggtgtgagctggcagatgttaccacaggacaaaattagaatgtgtaacttgtaaaacagcagagaaaaacttgatttctcccatgtaaaacaagaatgtaggaaaatgaaacaaatggaaaataaataatatggagattaagttccagtagacaatagttcaatggatatttatagatgagtaaactgactaatgaaaaagaattcttagattgaactttttaaaaataaagatccggccaggcgcggtggctcacacctgtgatcccagcactttgggaggctgaggcaggtggatcacgaggtcaggagatagagaccatcctggctaacaaggtgaaactccgtctctactaaaaatacaaaaaattagccgggcgtggtggcgggcacctgtagtcccacttactcgggaggctgaggcaggagaatggtgtgaacctgggaggcggagcttgcagtgagctgagatcgcgccaccgcactccagcctgggcgacagagtgagactctgtctcaaaaaaataaaaaatgaaaaaaacaaaagatccaacaataaaagatccagttaaaaagacagaaaaagtaaaaattaaaaaataaaatagaattaggcagaaaacgtcataagaggcaaagaagtctgttttttttttttttgagacagagtctcactctgtcacccaggctggagtgcaatggtgtgatctcagctcactgcaatgtccacctcccgggttcaagcaattctactgcctcagcctcccgagtagcagggattacaggtgcctgccaccacggccagataatttttgtattttttgtagagatgggatttcaccatgttggccaggctggtcttgaactcctgacctcaagtgatccaccctcctcggcctccaaaatgctgagattacaggcgtgagctgccatacctggccagaactctgtattttaaaaggtaagacttcagatgcagaaaaaagaaaaaaataaataaaaaggtacaacttcaaaacatgtcaagtactgacggacagagctgcaggaaagaggtaactgagagtagatgaagctgttaactcacccatgttcctcaaaaacaaacaaacccatgtcctcctggcaaaaactcattcatcaacggggactggttggcttgagtcatgaggcacaggaggtctaaccttacaggtagatgattcactttctctttcggcaaacagaccatgcctagaatctcatcataccaggccacagagcaagtctcaattcatttcaaatgtaacacaataaaatttgaaaccaacatcaaaacctctcatcctgcttctgcttcaaaattgtaaaacctactactgaataatttttggttatagagaaaatcataaaatgaattatttatgccgggcacggtggctcgcgcctgtaatcccagtactttgggaggccgaggcgggcggatcacctgaggtcaggagttggagaccagcctgaccaacatggagaaaccctgtttctattaataatacaaacattatctgggcatggtggcacatgcctgtaatcccagctactcgggaggctgaggcaggagaatcgcttgaaccctggaggtggaggttgcggtgagccaaagaaaaaaaaaaagaaaagaaaaaagagcatatgtgcaggagtagaaatagacagaagacagcctcatcatctcctcagcacaaaaacagaatcaaagacagactttgtttgtttgttttttgtttttgttttgttttgggacggagtcttgctctgttgcccaggctggagtgcagtggcgcgatctcggctcactgcaagctctgcctcctgggttcacgccattctcctgcctcagcctcccgagtagctgggactacaggtgcccgccaccatgcccaagctaattttttttgtattttttttagtagagacggggtttcactgtgttagccaggatggtctcgatctcctgaccctcgtgatccacccaccttggcctctcaaagtgcctagggccctttttttttttttttttttgagaggctgtcttgctctgtcgctcaggttggagcgcagtggcgtgatcgtggctcactgcagcttcaacctcccgggctcaaacgatactcctgccccagcctcccaagcagctgggaccacagacatgtgccaccacatccagtcttcttatcttttaaagcatgttgggccttgttttgaaataaagttaggttatatgttttcttgttttttgtttttgttttttgagacagagtctgctctttcacccaggctggagtgcagtggtgcgatctcggctcactgcaacctctagctccaaggttcaagtgattctcgtgcctcagcctcccaagtagttgaaattacaggcacctgccaccatgcccagctaatttttgtattttcagtagagacggggttttaccaagttggccaggctggttgtgaactcctgacctcaagtgatccatctaccttggcctgccaaagtgctgggattacaggcgtgagccatggtgctcgccttcttgtcttttaaagagtgttgggccttgttttgggtgaaagttgggttatgtggtgttttttcttttgttttgttttgttttttgagacaggagtctgctctgtcactcaggctagagtgcagtggcgcgatctcggctcactgcaacctctgcttcccaggttcaagtgattctcatgcctcagcctcctgagtagttgggattacaggcatgcaccaccacacctgactaatttttgtatttttagtagagacggggttttaccaagttgaccaggctggttgtgaactcctggcctcaggtgatctgcccacctcggcttcccaaagttctgggattacaggcgtgagccgccatgccaggccttggatttctgtagctgcagtttctcaggcaggttctagacgagccttcactgcagacagcatcagccctgttcccacggtgtggctcctcctgagtctccactgaatgtccacagtgatcactggggacccatccccctggctggagcttcagtatgtcatgaccgtgtgcgaggtctggaagttgttcaccttacatgctcctttctcctctttgcctggctttgtggagttttcttctatacatgtacaggctggtcctcagtacagactcaagagaaccctgtgcagatttctggagctcttttctgcagtttcctccttgcgggattctgccctgaaatgccggctccttctgtgtccccagaccctagtgcagtctcagctccgtaagggtgctcagctttgctcaggccctgcttccctccctgtgccggcagcccagaaacggccttcaggcagaaggccagggccccagggttcaccttgcctgtctcccttccaacaagggtggcggtcttgtccgggatctcggactcgtccagggtctcggtcttgttggggatctcggtcttgtttgaccagttgtccaatgtctgcaaacagttgtttcatatactttgtccagttttctagttgttcatggaggaacattaaagtctggtccttgtaactacggcctggccagaagcagaagtgagtgccagccgttgtgtgggcatagaataaatattatcagaaagtaagccgatttggttatttcttaatgtatttactttgttctaaaagttatttcaacacaagttactttcctaagtggcagtcatggtttcgtcactacaatttcaagaaaagagctaacagacatctacttgaccatctgtttctcagaaagttccaagactgccctgtcctttcagaagccacaggtcatgataatcagtgaaggcggggggctggggttgtccgtgccattcagggcaccccagtgctcccttcttggccagagcactggttcttggattcctgtagcttcagtgacaaggtgctgtggggctgtgcatccagcctcataaaatgtcaccagcgtgacctgctctctcagtcacagcttgtcctgagagcagcaatgggactagaacgacaggagcaggtagtgagaaacaagagagcagggtcctctccttcctggacagcaggactgtcctgatcccactgcaaggctgctgtgatggtgaccagtgaggcccgcgctgcatgtttttgcacactgaggagctgcctccattcattccccctcgcattcctggagcccacgtgctccttaccaagctcgcctcctggttcatgtttgggtgaagggctccactccacgccaggctgggcgtggggcccacacctgtcatctcagcactttgggaggccaaggcggcaggactgcttgagcccaggagttcgagaccagcctgggtgacatagtgagaccccatttctacaaaaaaataaaataacatgtaaaaagattagccagctatggtgatgtgcacctgtagtctcagctactcaggagacaaaggcaggaggatcacttgagcctggaaagttgaggccacagtgaaccaagattgtgccactgcactctggcctgggcaacagagcgagaataaagtaaataaataagagccccaaggcccccttgcctgccctgcagcttggtcttgcagctatgttgggctgtccatctcaccttggccatcaggagcctgacgtgcaccttctagtgcaggttacctgggccctgagggggttccctcgtcagtacacagagtgacgccacagatggaagagtggactgtaacgttccctgcgcgtttacagaggaggtacagactgttcttcactgtccccgtttcttaacatgtcacagccggctcctcacccatccatggcggggccatcccgacctgctctcctgaacgaaatgaacgaaagccctgggtgtcataagaagcacaaaagtgcctgcggaggtgggggccagaggcagcatggggacttctggctgggtgaggggggagggacgggggcgtgaggatgagctggtgctgaggccaaatgctcagggcatgtttttatgtcttgggagcccagctggtcctgcagaggccaatcacactgaaatgccactctggcgttctaccatcctttcaggaaaggcccagaacagtctcagctcaaaagcacaggaccccaggcaggggagggagggagtgtgtcctcggcgcccactggctcctgaatgcagaggctggcagcccctgcagggccacagtgactaggtggagggcggctggagctcggctgtcacgatcccgtgctctgtcttctcagtggcgaggtgtgggagtggagacacgctcacccacagccactccacccccaggcgtggtcccactggagcccaccaaacctctaaaattgtaaacatgactcttagctggagggccacctgtggggcaggagtgtgccatgatttggcccatactttgtttggatttacttagttgccaatattttgaaaaggaaacactttatatataaaaagaacaggatttccagcctctctcagaaaaatgggaagacaggcttgttggccccacactgccatggagggcggccctggggtggcactgacatggcctcagaagaccaagcccgcccgcagggacaccactgcccccactccacgaggctggcagtcaccctgtgcatgggcacctagtaccttctctgcagaggaggctctggcctggactggatccagggcttggattcagatcctgattccaccagctggggctgtgtgactttggacttggccttcatctgagcaaagagccccagcctgcggcaaccactggggccgagcagggcagtcactggagccctgtgtgatctccagcggaggctccaccagcattcgggctgtccgggaagagggggcaagagggggcaagagggggcaagagggggcaagagggggcggcttttgtccttctttccctttggatctttagatgagaaaagcctggctacaaggtgtcttcaacacacaaaactgcccagaaatgctctaattctacaaacagtttaaaaaaattaaccgagttagcagccagttaacagaattatgcgaccttaggatacattttatgggccaggcatggtggcttacgcctgtaatcccagcgcttagggaggctgacatgggagcattgcttgaacccaggagttcaagaccatattgggcaacatagtaagaccctgtctgtacaaaaaaagtttttaaaaattagctgggcatggtggcttacatctctggtcccagctactcaggaggatgaggcaggagaatcacttgaacctgggaggtggagtgagctgagatcgcaccactgcactccagccggggcgacagagggagactctgtctcaaaaatacaaaaaatttatgcaacctttttttttttttttttttttttgagatggagtctcactctgtcgcccaggctggagtgcagtggtaagatcttgactcactgtaacctccaccctccgagttcaagcgattctcctgcctcagcctctggagtagctgggtttacaggtgcctgcaaccgtgccaggctaatttttcttatttttagtagagatggggtttcaccatcttggccaggctggtcttgaactcctgacctcatgatccacccgcctcagcctcccaaagtgctgggattacaggcgtgagccaccgcgcccggccacaacctttttttttttttttttttaaagtaaacatctcaaaatctgtggagaaacaaatataaatttcaaaagaacaaattttttaaagaaaaaaaaagccagcattaacatgggacaccctttaaagttgtgaccatttttgctcctaaaccatcctctgcagctggagagtggggtggggagtgagggtgggaggcaggggggcctccacctagaagaaaacaaaatcactcacctccgacccacccacagggtgcatggcagggaccgcctccaaatcccacccccagggagcggcccaggggcggcccactgagccctggccccaatcttgatgaggctctacatggcggccctacccacttctcctatgcagtcttccccacccccacagcacagccgaattcctcagaagctctggccaagcatctcctctgaccccaggacatgcttggccctccccctgctctaatcagacaagtcccttccagaactccagggtgcagaacaagggctgggccttgggaccctcagctatgggatctgtggccatgtagcgttgggcctcatttctgcatttgacaatgggatggtagtagctgtacagccttagcctaaagacctgagcacaggtgagacaccaggtatggtgtctggcacttagtaggcactcaacaaatactcgaggaaaacacacagaaccattcccattatgtgtatctgtaaaccaggcttgcagccctccctctggtctccagtctaggtccccccacagcagggccctctccggaaagctcctgtctcccttcgagtccctgactttcagaagtcacaacaaacgcccatttttctgttgctagctttcctagtcccctttgaaaaggacaaaaatgtcgacaacacataaaccacatataagatggccaattgataggaaaaatgaccaacctcatcatttaaaaatggcgaattgggccaggtgcgatggctcacgcctgtaatcccaggactttgggaggccgaggtagatcacttgagcccaggagttcgagaccagcctgggctaacatggggaaaacccatctctacaaaaaaaataaaaaaattagcgaggcatggtggcgcacgccataaccccaactactccaggggctgaggtgggaggatcacttgagcccaggaggtggagtttgcagtgagctgagattgcaccactgtactgggcgacagagggagatcctgactcaaacaacaaccaggcaaattaggccaggtgctcatgcctgtaatccagcactttgggaggccaaggtgggaggactgtttgagcccaggagttcgagaccagcctgggcaacatggcaagatcctgtctacaaaatgtaaaaaattagccaggtgtggtggtacgtgcctgtggtcccagctacttggaatgctgaggaaggaggaatgcttgagcccgggaggttgagaagcctgggaggttgaggctttagtgagccatggctgcggcactacactccagcctgggcgacggagtgagactccatctcaaaatacatacataaaataaaatggactagaaaaaaaaggcaaattaaaaccaataatgaagtatcagttttgacttatcagattggccaacaaacaaacaaacaaacaaaccatttgctaaatccaccaatactgagtgaggaaaggtgcctcacgcctgcaaccaggagcagggggccaacgtcctgggggcaattgggtaacagcgctcagaactcaaactgaccctacctttgaccagctatttcccttctgatctaacagcagcctctgtgagcacgcagggcacacgcacaggaggttcactctcttaagagctaaaaacgacaggccgtccaagtgtccacaaacatcagacaccaaaacaaagggaggtgagccgatgcggcggctcacaaaactaccagaaagatctgtcggctctgtgtgtactgacataaaaaatactgcagacataaataaaaaagcaagctgcccccacgatatgcaattgacaagaaaagaggatatacacatatatttaaaaaaccacttctgttctgagggtggctggggagtctggaggggtgcagggggactgggcagttgtggcctggtgggtagggactgggagggagtaagagaagagggagaaggaacacagtccactgaaacccagtgtggtgttatccattagcgcaggactgaaacccgatgtgggtgttatccattagcgcaggactgaaacctgatgtgttattcattagcgcaggatgccccacgcatccggagatggggtttggaacatcctttgccccagcgaggtgcgaggtgctccggaacttgcggggcttagctgcccacacacgtgggacagactgttgggtggctggtccctgtaccggctcctgaaaggacatttgggcacttgatacacacccataaggtgcactctagggaggtggaggcaggcctgctgcagggggtcggcttcagaagcaggtatttctttggggtgaggtcagacatctgcctgggtgcttctctggaactgccttagggagagcttccgtccgcactgggtgccactcagtctgccgcgctttttatgtacgctgacttttgttgtgctgctgaagaatatctttccagtttgatgatttttcaggtaaaaacactaccttagaaatctgtgatttcttcacccgtatctaaggttaaccctcttccggccatttgtaaatactccattctacttctgcgtattttcgtggtttgccttggagtccctccctcgccctggaatgcctggtagtgtgtggtccccgtgagaggaagcggagatcagagtaagctgtgttcccaccctgccaattgctgaatggttctttctttccttggctcctggagaacaactacattcttatctaccaggctccactgagcgggcgggaggtgggggcgggggtgggggtgggagtgggggcaggggtgggggtgggggtggtgagaaattagtcgtattttgattagaatgacactacagattactttactttggagaaaactgctgcctttgtatatttaatgcttccatccaggaagtgtcatttttttaagcctcaaacatttttttggataatgcttggtagtttctctagcattatctgagactaacatcttctgagactcctgggttttgtagactcggggcctcccatgctcccatccctcacagttatctccctgtacgtggagcagacaggaatcaaggatcatgcccctgcacctgtgggtgcccccccacccctgtgcacctacgggtaccccacctgcagaccatgcccctgccctccgagacattctgaagcagaccgatagaatcaagtttaggaagaaaaatggcatggcctggggctggtgcaggaaggaaggaagctggatgggggacaggtctcttgggcagcctttggaggaggcaggtgctgggcaaacaaggagggtgcctgcaggtgctgcaaggtctgcaggtggggtacccacaggtgcacaggggttggggggcacccacaggtgcagacaggctggagctggagtgcaggtagctgggggaagaagggagggagatgaggctggacgtgctgggccccagcagtctgtgtgggagacctatctatctgaggctgtcataaaaacgcaggtgagagaggaggctaggcttggaggtgggtcctccaaagagccgcatccagggtgtatgggggagccccgactccagccagctgttccagcctcagaggttggccgtgccctgggacggggtgactgctgggtctggataggttggcaaagcagggctgaggacatgagcaggagggtggttcggggcctatcccaggtccaagaggagtatggctgttcaacacagctgtgtgacgtcgtgactaaacaccatatcctacaatagtcgttcatgtcattaatttagatgccactaaattgttaactatttcagtatcatttcattattattattattattttttttttgcagagatgttgcccaggctggtcttgaactcctgggctcaagtgatccgcccacctcagcctcccaaagtgctgggtttacaggctgagtcactgtgcctggcaacattattactttaaactccaatcatgactgtgtagtgtgcatactctgttacccacaatgcatggaacacgtttaaaaaagaggaggaaacttcctctccgtttctagaatggagctttcagactgcttgtctggcgagcgactgccgagctgcgctctgtcctagtgtcggtgcactggagggcgcagtgtcgcatcttaaccagaaacccggtgcccttaagtggcaccccttacttcaccaacgcagtttccaaggttttaaggaaagtattcttacatgaagtaaaaatatcacacagataattcagttaagcatgctcaaatattcaaaacacaaggaaagcatcaagatacttcgcagatcattaaacaactcaactgcatgaaccactttagtcttttcctaaatccttcacagggtgaatcaaaagccccatggacttatgctgaaacgtatctttcttgcttgcttttttttttgagatggagtctcactctgtcgcccaggctggagtgcagtggtgcaacctcggctcactgcaagctccgcctctcgggttcacagcactctcctgcctcagcctcccaagtagctaggactacaggcgtccgccaccacgcccggctaattttttgtatttttagtagagacagggtttcaccgtgttagccaggatggtctcgatctcctgacctagtgatccacccacctcggcctcccaaagtgctgggattacaggggtgagctaccgcgcccggcctcttgcttgctttttaattgcaacaccgatgctaagaaataccagccgttgccaggcatggtggctcccgcctgtaatcccagctactcaggaggctgggacaggaggattgcttgaggccaggagttctagcccagtctgtgcaacacagtgagaccgtgtttctaaaataaataataaagaaaaaataaataccagccaccctgtctcagcctagggaggcagggacatggcagggcctgcatctggccacctcctccacctgctgaggcccccagtgcttccccagctttcctgccaagaggccccagtgctactgagctgcaggcagcaggctctcgaggacatgacctcactcacagggctcagggtctaagactctgttaagacaggcgcctggagccgggtcatagggaggcaacatgacccccacagccaggagatggacagcaggtctgctgagggctctgggcagcttctccctccctgattaaaagaaaaagattcaggagagagaggcccttcaccttttggccttctcaggggatggtgggagtgtctgcagccattgcggagccattaggagaaaagagaatcccagaggggccacctgaggcccgttgacctgggactgagggctccgatgagctcctgggcctcagtcagcgcgtcctgccatggggccgtgcatgccgcctgctgagaccattttgggcactcaggatatggacccctcagttctctccttattttagtgaggcgtgtcattttccacagttaccacgaggagataaaggccgggaagctctggttcacgtcactttcatatcctgtcctgtgacttgtagctaaaagcatcttaactgatccacaccagcccgccttccctcccaggccacccacactctcagcctcggtggacgtgtgctgctgtgtcaggaacgctccttcctgcagcacggcctcggccccaggtgactcctgtggtcaccagctccctggtctcacagagagcttggtggccctcttcactctctcccggatctgcttcctgaggcgccaacccaccattttacaacccactttctcaagcctcctacaccgctccttcctccttcagagcctgtggccggcctcgggctctcagcctggatgctgagcatgtaagaggaaatgaaaggaatctgccagaaccgtttcccaccaccaggccagctgctgggaccagggacagcctccctggggcctgtgcactcccgcacggtggaggctgccctggccactgctgcagaccctttgcaagggcgtctgtccagcaagcagctcagaagtcggagcaagcatctccctcaggcccagggcaggtgcttgtggcgctctaggactcggagggcaggtgctcgtggttgctctaggactcggagggcaggtgcttgtggtcgctctaggactcggtccccaggcctgggttcctcagctgagatgcatacccactgcacctgcagccactgcctgcccagctgcctgctatgtggacagagcccttggtctctgacccaggagcctcctgtctcccgccaggcttgcttgtcagcttgcaggctgggcaagtgcacagcactggctgcaatcaaccttctggcttcggtgcccacctctgcctctgtcctattaaaggccagccctgcacacgggcaccgagccccttcccctgcctcctccaggacttctctcctgagtcatcccatttcccactgcctaccggcaggctttacatgacagcttgtgagcctcccctcttgactccacatcttcataaatacggcctcttttcactgctgattttcagagcaaagtttcttggatatgttgtccatcccatctcccatcctctccccaagccgggaaggattgaatgaaaattctactacccccctgagaccacacttaagaccaccagtgaccttcaccttgcaaaaaagcaggggctgcttctctgtcctgacctaactggacctacctgtagcgttccactgcacagtttaaccactccttccctcctaataactttttttttttttttttttttgtagagacagggtcttgctctctcacccaggctggagtgcagtgtgtaatcacagctcactgcggcctagaactcctgggctcaagtgatcctcctgcctctgtctcccaaagtgctgggattacaggcatgaaccagtgtgcccggccctttttttttttttttttttgagatgatgtctcactacattgtccaggctggtgtggaacctctgagttcaagcgatcctcccactttagcctccccaaatgctgcaattacaggagtgagccaccgcccggcctatagcaattttcatgtcagacaaaataggttttttggtgaaatacaacatgaggggttatgagggatgttacatactggtaaagggaggaaaagatcaagaaggcaaaaaacctaaacatgtatgcacctaacagcgaacctcaaaacacataaagcaacaattgacaaaaacagatagattgataattgtagtttaagaactaatatttccctctcagaagagttaacatcatagtaatttaattctctgaccagaatgtaaaaatattagaaatcagtaacagacaaaaaaataaaattccacaaatctagaaacttaaggaaaaattccatttaagttaaagcaaaatgagttgagttataagtcctacaagggaaagacaagggaaacatgaggatgttgagatttatgagacatggttaaagcaaagcaacgcttggaggaatatgcatttctttggctgcattggtcagaaaacaagacagatttcagacttgaagaaggcatcatgaagctagcactcctccactatccttgtaaatcatccaaaagcaaaaaaaaaaaaaaaaaaaaaaagataatgaaaagcaaaaatgcaaacttcattttcattaaaactaagagctagaattggtggtggtggcgggggctaccaaaggctgcaggaactcggcaagggctgtgtcaaagacatacagatgcctcgttacagaccccagaaagagcagagggcatttctctaaggcaagggtacaccctgagggtaggacctaattccttgtttcaggagtaggaacatgggctggcagcaagtgcttccctgaccttgttccgttcctggaagagaggagggagagtgaaccaggaacagaacaggccctatctgcaaagtgcagtatctgtggggaaagggaagagagaagctgtatcagctgttaaaagcctgataggtggagacttgtatttaaagctaaaatcaacgacacgactctgctgggctggaagatggttctggcttcattttccatacaaactttttcaaatagctagtcaagtaaaaatttacctgttctaaagatgaggccaggcacggtggctcatgcccgtaatcccagcactttgagagcgtaaggtgggaggatcacttgagcccaggagttcgagaccagcctgggcaacagagcgacaccttgtacctacaaaaaactaaaacaatcttagctgagcgtggtggcgtgtccctgtggtcccagctacttgggaggctgaggtgggagaatcacttgagcccaagaggtcaaggctgcagtgagctgagattgccgcactgcactccagcctcggtgacagaatgggacactgtctctaaaaagagaaaaagaaaaaaaaaatgaggggggagccaagaaacgaaagtgctccaagagaaaaggagaaaggaaacaagcaaacgaatgaacacgaacgtctccagaagaactttccattgagttgatgaaaatttggacaaaatgttttgtggtgaattaaaaatgcaaggaggcggtgcccctaagaatcctgagcacagaggagagccatggagtgcaggtgggagggtcaggaagacggagtgggacgcggctgcgtggaagacagagagaaacgcgccacattcgtgatgccagcactggagcacacggggaacggaagccacacaaccccattccttcctaaggcagaagggaagctgcgtcaatcctaagaacacttacaatagtgtttgtggggaggggctgggggaaccagactcagacaagccaagtctaaaaattatatacaaaaaaggccgggcatggtgactcacgcctgcagtctcagcactttgggaggctgaagcgggaggatcgcttgagcccaggaatttgagatcagcctgggcaacatagggagacaccatctctactaaatttttttttttttttgaggcagagtctcattccgtcacccagactggagtgcagtggtacaatctcagctccctacaacctccacctcccaggttcaagtgattctcatgcctcagcctcccaagtagctgggattacaggcatgcgccaccaggcccagtgaatttttgtatttttagtagagacggggtttcaccatgttggccaggctggtcttgaactcctgacctcaactgatccacctgccttagcctcccaaagtgctgagattataggcacgagccactgcctccagtcctctctctactaaatttaaaaagaaagaaaaaagaaaaaacaaatacatgcaaataaccaagaaaaccctgagagagaaggataaagaggagatcctacatcagccagacatgtaaaaggaccaggaagtgacactgattctgacccaatggaactgcctgtgaacagactgagagtggccgaacgaaccgtccggatatagctccaaaagcacatggaacatttagcaccatgacaaaggtgggagtccgaatatgcgggaagtgtgagcgatggaaaactgggagccgttgccactttgggggttaataagaagtggttctggccaggcacggtggctcacccctgtaatcccagcactctgggaggccgaggtgggcggatcaactgaggtcaggagttcgagacgagccagcccagcattgtgaaaccccgtctctactaaaaatacaaaattagcctggagtggtggcgggtgcctgtagctccagctactggggaggctgaggcaggagaatcatttgaacccgggaggaggagcttgcagtgagctgagattgcgccattgcactccagcccgagcaacaagagcaaaactccatctcaaaggaaaaaaaaaaaaaacagacaagataaaaaacaaggacattaaattacataaaaataaaaaatatgaacataaaaaaacaccataataaacatttaaaaacatgaagaactgggagaaaacatttaaattgttgtcaccgaaaaggcctaatttctatcacatataatgagctgctacaaatcaataagaaagaccacaatctaatacacaaatgggcaggtaactgaagaacagggaaaggaagtggctcctaaacacacacgaagatgcacgacctcccagcagaggcgctgatgccaatcctgctgccaccggcaaaagttccgtgtggctacaggactctcagacactgctgctgggagcagcctctgggtgggtggcggaggctgaggcgatgctgtccaccacacgtggcacgcgggcagccttgactacgcaagcccctggggcacgtacacgtgtgttttcacacacactgcagcctgtaaggttactattctaacagtatctgtgacggtaaaggactggaaatagcctaaaatgcgcatgaaggagagaatgattaaatgaatgaggcacaccctcatgacggaagacagaagctgtaaggtaagaaggggacgccctccatgcaggcacacaggaaggacgcacgctcccgccccaaccacatcacacgtcccgcaactccagctgcctcgaagcagcatctgtttccctccccccttctcgctacatcacagacccatgcagtcctcacaaggtgcacccttcaaacagacttttctgaaaacttcctgagaccagtagcaggagctggcactgtgacctgctgagtttaccaggcctatgacttaggtgcagagaagagtctcagggcggcaacgtccgcgcagcaaagcaggacgaggatgaggatgcggctgacacttgtctggcccgtgaggctgagcatcactggggtcggcctggctcttccccgggagcatcgctggggtcgacctggctcttccccaggagcagggccgtctaaagtgcaccaatgcccacgcgtctcacctgggctccattctaagtcagcctgcgcccgggtgtacagtgctccattctaagtcagcctgcgcccgggtgtacggtgctgcattctaagtcagtgtgcgcccgggtgtacggtgctgcactaggaaatggcatggtttctgcccttcagggctttgcaccataacccgggaaacactcaggtgccaaatgagaggtaaagagactccatgcattactcaaccaaagtgcagggatttcagggtgcaggaggcacgcagggtgctgactctccacatgcccctcggagagggtggccctcgccagctgccagctgtgggcagctcctggggagggcagtctcctacctggagttgagtcaccctgggaggtgacaccagaagggctggatcccaggtctagcaacctccacatgtcctggagggtgccactggcaaaggaggaggagctgtgggattggcgaccatgctcctcagggtgctggggagcctggggtggctttggggacctgtcttctttctgccgaggtgatttacaggtcaccgtgtggatgctgtgttgtgtctagaaaagacatcatcgtcttgaaagccaccctctccaacccagaggaagccacaggactccccccaaccactcccctcggagcagtaaggcgacagtgggcctggcttaaaggcccaggcagatgctcccaggatcacccaggagaggcagctgcagacagggatgcatccggggagcgagtctcagcgctgggaacgctgagtgtgggcagggcctgaatctcagtgctcgtctcaacacttaaatgacaaaacatgtctagggcagaggctgtttcgtttcgatggggaatgagctgaaatgcagggcagataccctgaggggcacagaaaggaaaggccagcgtgggccccatgtgctttaggggtcccggggccctcctaacactcttaccacccttgtgggaccacccggcaaacgctctgcagctcaccctgccattgtgagcagtccctgatgacggcacaaaggcaggcatgcagagcgaaggcccctccgagaggcccagagcacccaggccccggcttccctgctggccacaccccacacagctgcacttgctcgggcgccgccactctcaccttcgggccttgcagggcgtcaagtctgctgcccacctgtgctgagcggggctggtgctttcccaagtgtctggaaggagcctcatcctcggcactcttggcgtcctgccgtggggatttaaatgagaggactctggtattcacatgtactgatggtgcatgtcagtgagttttcccacaagattgggaagaaatgccttcccacatttctggtattaaagactcacaccatttggtgacagcccggactgaagggacctgtttcccagacaggaggaatggagcaggcttccccagtcattcattcccaggagccttctctgcaaggccagggcagcctatgcatggcctgcctggggtgagagccccccggcccaagatggacacgagtggcccccagtgacaccacctggccgatcctgcttttttgttttttttttttttgagacggagtcttgctctgtctcccaggctggagtacagtggcgtgatctcggctcactgcaacctccgcctcctgggttcaagtgattctcctgtctcagcctcccaagtagctgggatgacaggcacccaccaccatgcccggctagtttttatatttttagtagagacagggtttcaccatattagccaggctggtcttgaacacctgacctcaggtgatccgcctgccttggcctcccaaagtgctgggatcacaggtgtgagccaccacgcctgacctgatcctgcttcttgaacccatcactggtgcctctgcccgccccatgcctgatgtctccccccttctggagggaagactgtggaaaggaagccaaaagggggcactagggagcaaaccctaagaacatggaaaggaaacatggaggaaaacagaaagggaaattcaaagcagtgggacctgtacagagccatggacaatagatggcctgcaaggaggctgtggaacgagcccagccctgccccttcccaggcacaccatgagtgtgcccacaacagtggatgcagagtgtacttggcccatgtttaccaacgtttgcctgttcacccgaggaatgcacatgcatgaggtctgatgtaaggtccctgatgccagtgatcacgggcacagcctgatgctcactgccccccgggcttcgtccccagtaccttctgatcagaccctttgcctgtttgtcacagggtgatttgtctttttcttattgatctgtaggagttcttttctgtatttgtatcttatttcttctcatatggcaccatttactattaaaaatacagaggaaccccttgggaggctgaggcaggaggatcactggagcccagagttctaggttccagtgagcctggatcacaccactgtactccagcctgggcaacagagcgaaactctgtctcaaaaaataaataaataaaaaattaggctgggcgcggtagctcacacctgtaaccctagcactttgggaggccgaggtggaagaatcccttgactccaggagtttaagatcagcctgggtaacatattgagaccccctatctgtacaaaaaaaaattaaaaattagacaggtgtgatggcacacacctgtggtctcagctactacggaggctgaggtgggaagataatgtgagcctgggaggaccaggctgcagtgagctgtgatgtcatcatggcactccagcctggggagcagagaccctgtctcaaaacatttttttttgagacacagtcttgctctgttgcccaggctggagtgcagtggcgtgatctcagctcactgcaacctccgcctcctgggttcaagtgattctcctgcctcagccttccgagtagctgggattacagatgcccacccccatgcccgactaagttttgtatttttcagtagagatggagttttgccaaattggccaggctggtctcgaactcctgacctcaagtaatctgctcgccttggccccaaaaagtgctgggattacaggcgtgagccaccacacccagacaaaactttttttttttttttttttttgagatggagtcttgctttatcacctaggctggagtgcagtggtacaatcttggctcactgcaacctccacctcctgggttcaagcgattctcctgcctcagcctcccgagtagctgggattataggtgcctgccaccacaactggctaatttttgtatttttagtagagatggggtttcatcatgttggccaggctggtctcgaactcctgacctcagatgatctgcccgcctcagcctcccaaagtggctgggatcactggtgtgagccaccacgcccagctccttttttttgggggggtgggggtgggggacggagtctcactctgtcacccaggctggagcacaatggcactatctcagctcactgcaacctctgcctcctaggttcaagtgattctcctggctcagcctcccgagtagctgggattacaggtgcctgccaccatgcctggctaattttttatatttttggtagagacgaggttttgccatgttgcccaggctggtcttgaactcctgacctcaggtgatccacccgtctcggcctcccaaagtgctgggattacaggcatgagccactgggcccaaatactggccacattttttttaaaagaaaaataaatgtaggccaggtgtgttagctcacacctgtaatcccagcactttgggaggctgagacaggtggattacttgaggtcaggagttcgagaccagcctgggcaacatggcaaaacctcgtctctatcaaaaatacaaaaattaactgtgtctggtggtgtgtgcctgtaatcccagctgctcagaaggctgaggcaggagaatcgcttgaacctgggaggcagaggttgcagtgagtcaagaccacaccactgcagtctagcctgggcgacaaagtgagactccatctcataatgaataaataaataaaataaatacatgccgggcctggtggctcacgcctgtaatcccagcatttgggaggcagaggtgggcaaattgcttcagtccaggagtttgagaccagcctgagtgacacggtgaaaccctgtctctattaaaaaacaaacaaacaaacaaaaattagccaggcgtggtggtgcatgcctgtagtcccagctacttgggaggctgaggtggaaagatcacttgagcctgggagacagacgttgcaataagccgagactgtgccactgcactccagcctgggcgacagagcaagaccctgtctcaaatataaataaatacattttaaaaagaaataaaaaaggaaacacaaagcagtcttggctccatagagttttcttttctcagttttaagagttatttcttatgcctgtaatcccagcactttgggaggctgaggcaggaggatcacttgagttcaggaatccaaggccagcctgggcaacatggcgaaaccctatctctacaaaaaatacaaaaaataaggccaggcatgctggcgggcgcctgtaatcctagctacttgggaggctgaggcaggagaatggcgtgaactcgggaggcggaggttgcagtgagcccaaattacgccactgcactccagccttgggtgacagagcgagactctgtctcaaaaaaaaaaaaaaaaaaaagaataaataagaaaggatagccaagaaaattttgtaaaggaacagaaataaggtcaagcttgctctaacagatattaaaataggtcacaaagccacagtatttaaagcggtatagtaccatttcaggaacagacaactcattggaactgtgtagaaaaccccaaaatcaatgcagaagctgaacttctcaaggctgcaacatgagacagatccacagtctacaaaacactgcctgacttttcaaaaagacacggaaaggcggagggagtgttctgggttaaaggatgaaaacacaagagccagatgcagtgggaattcgggactggctctgaggttacggaaaattagcaaggaacacacataaatcacccacagaagaagaactataaatggccaataaatagattaaagcatttaatgccactaaggatataagaaatttccttccttctttgttttttggtagagacggggtctcgctgtgttgctctggcgggtcttgaactcctgggctcaagcagtcctctcacctcaacctcctgagtctgggattacaaggtgtggactaccacaaatgggtaatttatttttatttttatctttctgtagagacaaccttgcttttttttttttttttttgagacggagtcttgctctgtcgcccaggctggagtgtagtggtgccatctcggctcactgcagcctctgcctcctgggttcaagcaattctcctgcctcagcctccccagcagctgggattacaggcgagtgccaccatgcccggctaatttttgtatttttagtagagacggggtttcaccatgttggtcaggctggtctcaaacttttgacctcatgatccacccgcctcggcctcccaaagtgctgggattataggcgtgagccaccgcacctggccatcttgctatctttttaaagatacaagttgtggctgggtgcactgactcatgcccataatcccagtactttgagaggccatggtgggcagatcgcttgagcccaggagttcaagaccagcctgggcaacatggcaaaactccatttaaacaaaaaatataaaaattagccattaggcatggtggtacacacctgtggtcccagctacttggaaggctgaggtgggaggatcacttgagcctaggaagccgaggctgcagtgagctgtgattgcaccactgcactccagcctgggtgacagagccaggccctgtctcaaaggacaaaaaaaaaagaagtttttgggttctgggtgacagagccaggccctgtctcaaaaaaaaaaaaaaaaaaaaaaaatagaagtttttggtttttttttcacttatcataccagattaaaaaaatagtacccagatatgtaaagctatagtaaaacatatacatgatacaatttgtaatgaaaaaataaaaaaaaatgggggctgggcgcggtggttcatgcctgtaatcccagcactttgggaggcagaggcgggtggatcacctgaggtcaggagtttgaaaccagcctggccaatatggtaaaaccccatctctactaaaaatacaaaaattagtcaggcgtgttggtgcatgcctgtaatcccagcaactcggaaggctgactcaggagaattgcttgaaccgggagggggaggttgtagtgagccgagattgcaccactgcactcaagcctgggcaacagagcaagactgtctcaaaaaacaaacaaacaaatgagaaccaaaaccaaaccaaaacaaaacaaaaacccagcagaaaacacattgaaatgttactaataactatatctggatcctgaaaattggaggctttttatattgtgtttattgtaatctgaagtttctgtaatgaaaacgacacaattagggaaatatttttaaaaatgcatgtcttagatgaaggggtgttacctgagatgtaaaatggggctgcacctgtcccaaaggtgggctgcgatccaaaggcctcctgggctcctcgcctggcttccgggcctcaggggcaggagggagggcgtggtgcaacagccaccctgggaatgggatggggacagagtttgttctctgtgcatcacttctggattcctcttgtgttgaatgcaaacactcagaaagaacagcatgttccttttcaaaaccaaagtaacttccattacatcgagaacttggggagggccggacaacagtgaactgtgacacacagcatttcggtagagctcttgcacacacaatgccacgcccctgccacacacagcccttgctgtcctcacagcgggggcagcaagcacattcgctaacagaagcacccagacgccctttctgtggcaggcacaaagaagaagcaaaaacttgccaggtgcggaggctcacgtctgtaatcccagcactttgggaggctgaggcaggttgctcacttgaggccaggagttcgagatcagcctggccaacatggtgaaactccgtctctactaaaaatacaaaaattagctgggcgtggtggtgggcacctgtaatcccagctactcgggaggctgaggcagaagaattgcttgaacccgggaggcagaggttgcagcgagccgagatcatgccactgcactccatcctgggtaactccatctcaaaaagcaagcaaacaaacaaacaaaagaagcaaaagcttaagtataacaacttaaaaatgatggttctactcaaagcttcggcatgctagcttacttagaaatgaccccacatcaaacgagatcctttcatcaattccattcatgttatgttatgtaaagatctgctccttctctaagcagacacatcagaagacataattactgaaataacatttcccaggattacaaatcagtttcgttaaactcactgaggattccaacaaggtttttggagggtgtttataactgttgacatttcacatattggaaattgaaacagacatttttttttttgagatggagtttcgctcttgtcccccaggctggagtgcagtggcgcgatctcgacacccccagaacatccacctcctgggttcaagcaattctcctgcctcagcctcccaagtagctgggattacaggcatgcgccaccacgcccggctaattttgtatttttagtagagacggggtttctccatgttggtcaggctggtctcgaattcccgacctcaggtgatctgcccgccttggcctcccaaagtgctgggaatacaggtgtgagccatgtgcctggtcaaaacagaaaaattttaaagcttttttatcaattaacttgaagttagccatgatgaacatattgcttatgatcaacatctgaggagcatcgcaggattagctctgccctgtggacatcccgagatgggccctcaagtaaagcatcagtttcttctacgcaataaaagaacccaaagatgacacttggaaatgaacgtgtttcccttggtttataaacacctgaatttaaaagccatgaagtcagaagatgcacgtgtgggcaaaaacctcctgaagacactcaacaccattggtcaccaggagaatgtaaaatcaagcccactatgggatcccgcctcacacccactaggttggctgggatcaacaggatagaaaacagctgggtgcggtggctcacacctgtaaccccagcacactgggaggccgggtgggggggatccttgatgtcaggtgttggatactggcgtgggcaacacagtgagatcccacctctatttttaaaagaaatttttttaaatataaaaaaaataaagtttttaaagatatgcaataaaagtattcttaattaaaaaaaaccccgacagaaaatagcaagtgctggtgcagatgtggagaaatcagaaccttcgtgcgcagctggtgggcatgggaggcggtttggtggctccttaccaggttagacacagaattcccacatgacccagcaaggccacttctagggaggcatccaagagaactgaatgttcacagcaatattattcacaatagcccaaaggcggaaaccatccaaatgtccatcaaactgatggacaaatgcctacagtggcctgtcccccagcaaagagctcttcccatggaaaggaattaagtgcagacgccccagcacgagggaccctcaaacaggacacagagggaaagaagccaggcacaaagggacacatcctgtgggatcctgctgaagtgaaacgtccagaacaggcaaaggcatggaggcagaatgtgggtgctgggcgggggacaggaagcaactgcgaatgagtgtggggtttcctctgaagtgaaaggaattctggaacaaatgatgatgctcgcacaacattcttgacgtgcttaatgcactgaactgtatactttgtatacttcatgagctttcaacagtacattttatatgtatagtaccaaaaaaaaaaaaaaaaaaagaaaactagtttttttgagacagagtcttgctctgtcacccaggctggagtgcagtggtgcaatcgcggctcactgcagcctccacctcctgggctcaagcgatcctcccacctcagcctcccaagtagctgggaccacacccagccaagttttttgttttttagtagagacagggtgtcactattctgcccaggttagtctcaaactcctagcctcaagtgatcctcctcccttggcctcccaaagggctgggattagaggcatgagccactgcacccagctgaaagctaggtcttgttttctcaatccttacttggttgaaagaaagctagttttttaaaaagccatgaaatgtgttaaaatcttagcaaagttagcccaattttgatgggtttgtttccttggtgtactacttttttttttttttttttgagacagagtcttgctctgtcatccaggctggatggagtgcagtggtgtgatgttggctcactgcaacctccacttcccaggttcaagcaattctcccgcctcagcctcttcagtagcttggattacaggcacctgccaccatgcccggctaatttttgtatttttagtagacaaggggtttcaccgtgttggccaggctggtcttgaactcctgcaagcatcctatgatccgcccacctcggcctcccgaagtgctgggattaccggcgtgagccactgcacccagccttccttcgtttactatttattgacttcccctaaactatgaagggttattctttactttctatgtaatctgttcagacagcaaaggtgctgtcttaccagggtaattttccgtgcttttgttgacttattatgtcttgatggtttcagaaaacaaagcttcccatgcttatgaaagagctaagtttctctataactgttctctcctatgtttaagctttttgtcactttcacgtgggtagctaaatattatttctcaggtacccatgagtcttaatgttcaaatctcctgacatttttttttccttctcaaaattgaattctaaatgtcaaataaaataaagctttcaggagacttttcttttttttttttttgagatggagtctcgctgtgtcgccaggctggagtgcagtggcgcaatctcggctcactgcaacctctgacttcttggttcaagcggttctccttcctcagcctcccgggtagctgggattacaggcacccgccaccatgcctggctaatttttgtatttttagtagacgcggggtttcaccttgttggccaggatggtcttgatctcttgacctcgtgatccacctgcctcggcctcccaaagtgctgggattacaggtgtgagccactgtgcccagccccaggagaccttttatatttaaaatgatctatgagatgtcctagaagttccctggaaaatcacaaaatttttttcttataaaaagagaggtatttgaaataattaggtacaaggtggggtgtggtggcatgcgcttgtggtcccagctacttgggaggctgaggcaggaggatctctttttttttttttttttttgagacggagtctcgctctgttgcccaggctagagtgcagtggtacaatctcggctcactgcaagctccgcctcccgggttcacgccactctcctgcctcagcctcccgagtagctgggactacaggtgcccaccaccacgcctggctaattttttgtatttttagtagagacagggtttcaccctgttagccaggatggtctcgatctcctgacctcgtgatctacctgcctcagcctcccaaagtgctgggattacaggcatgagccaccgcacctggctgagacgggaggatctcttgagccaaggaggtcaaggctgcagtgagctgtgatcacaccactgccctccagcctgcatgacagaggtctctatcgaaaaaaaaaagtaaaaagaaaaaagatgttaaggaaatgattaggtttctttgatgtgttaggattgatgagtgccacgggaagactgccgagtcggaagagacgcatggcctgccccgggtcggaagagacgcgtggcctgccccgggtcggaagagacgcgtggcctgccccgggctgtgtgtgtcaggtaacttgttcgtctgaggcactgaggaactgtgtgctgtgctgcacggagacgtcccgggtgcccacggcgcttctcttcattagagtcccgaagccatttgccagatgctgtcagccggcagcagtccagagctagcaggcataaaccccgtcactgccgttacgttaacttaggtgtcaccttactttaacgtgagctgtgcatctctgatgcccagagtttgtagcagggcgaccgtcactcactctggggctgtgttactaggcagacggccaccgcctgccccacactttttgcctctccactggatattcttggtatagtcatggaatagtcagcttcacacttatctgtaaataatttcctctgtaaaaatcatgctcatccagttttagaaatcagatattctgtttctggcatctttgaaaacagcgtcaacgtcttggattaactttgtctagaactcttttttggactctgtttccagatgtctacaggacaagcaaatgttccttctcagttgcattattcttgctatgaacagacctttcactttgaaaagtggcagtggtaaattcaccatggccatgtgcagtcttttgtcatccacagtttttttatttttattttttgagacgaagtctcaaagaagactcctgacccaggctggagtgcagtggtgggatctcggctcactgcaacctccgcctcctgggttcaagcaattctcgtgcctcagcctttcgagtagctgggattacaggtgcccaccaccacacccagctaatttttgtgtttttagtagagatggtgctttgccatgttgaccaggctgatctggaattcctgacctcaggtgatccacctccctcattctcccaaagtgctgggattacaggcgtaagccaccacgcccagccccatccacgatttttgtgttactctgatgctccccagaaagctcagagtgcttcttcatcttgaacagggactgtctcagagcctgggaaaaggactgggcaggcaccatgggcacaggcttctgatggcggcatttagatgacactgagcccatcccaggactcagtctctagtcgagaagcagatggattgttgagaccaagaaccaagatggagtggaacaagaacggacctcacaggaggggatgaaccgatggtggaggatgacagcttttgttaagaatacggctgatgtttttttaatgttctactttctggatatatagagaactcttcctctttcctctgaagctatgtacagtccacacaaattttgtagtctctgcttttgtgaatcaaaacagaacatttgtaagtgataccttgttttttttgtttgttttttttgagacagagtcacgctctgttgtccaggctggagtgcagcagcgcaatctcggctcactgcaagctccgcctccccagttcacgccattctcctccatcagcctcccgagtagctgggactacagatgcccgccaccacgcccagctaatttttttgtattcttagtagagacggggtttcaccatgttagccatggtggtctcaatgtcctgacctcatgatctgcctgcctcggcctcccaaagtgctgggattacaggcgtgagccaccacgcctgaccaatttttgtatttttagtagagatggagtttcaccatgctggtcaggctggtctcaaactcctgacctcagctgatccatcggcctcagcctcccaaagtgccgggattacaggtgtgagccaccgtgcccggccagggatatcttactctcccggcctgagtcctccagaattcagaaacttgttgagtactcttactttcaaagtaatatagttatttgcatagtttcaatgagaatctttgttttttaccaggactggaattggaaatacttcttgtgtaaccaaggccctgcatggaaggccaaatctgagaagacgcccatttagtcagtcaccagcagccacttgtaaggaaccacagcgatgttacagagcccacatccacgaagccctccaaggagaacccggcacagcgcctggcttgtaggatggcaggtgcatctggagggcattgcctggcaggcccaggaacctgggctagtttggaaaccttaagaaaggaatttgctcaaatttatagggcaggtgaaatctggcgggttcttggcttggttttctagcctcaggacagcaagcaagaggcttttatttattttattttaaattatttattattatttatttatttattcttttttttgagatggagtctcgatctgtcacccaggctggagtgcagtggtgtgatctccactcactgcaacctccgcctcccaggttcaagctattctcctgcctcagcctcttgagtagctgggatgacaggcacgtgccaccacgcccggctaattttttttttttttttttttttgtgagacagagtcttgctcttgttgccaggctggagtgcaatggcatgatctcggctcactgcaacctctgccaccctggttcaagcgattcttctgcctcagcctcctgagtagctgggactacaggcacctgccaccatggctggctaatttttgtatttttagtagagacagggttttgccatgttggcaaggctggtcttgatctcctgatggacctcgtggtccacctgcctaggcctcccaaagtgttgggattacaggcgtgagccaccgcgactgccctaaaattattttttaaagaggcttttaaaagtcaatctgaaattctttacggaaacttctaagaaagcaaacttaagaatgcagagatggtgaattagcactctcgctgcacctatggaaataaccaagccatctacaaaccagctccattttgtgagatcaggaacaacctttctgatccttttgtggttcatccgcctgatgattgggttttcatgcagacgtgtgagctgtgcctccctcaagccttgttacaacatccgacatccgcacattacctgtctgatgcccggggaaaaaacacctttctttgagattactttccatcaaaagcagagaaactgtagggaaaaaaaatgagcttccgtagaaactgctttgtctactgcacttccactgggttatctgcgtccagcccctcattgtctttgcgatttgagctgctttgcgattttaccactgataggcatgcggattctgccctgcctgcctctcccctctaccagaaccagttctgcctccatctgaaactcgattcttttactccatgtagatttgtgcttttttgacctttccttggaactggttacagcatctgtccagtttcctcattgtttaatgaacagaatacaatcctaaacaaatgctcatttttcatatttgggagccacattttacttctttctgaaaattatcttttaacgcatagttaaataagtattgctggacacagttaaacctcagtaaggacactgtattatgaaccaggatgagccatagctgtcctgaacatttctgctctaagtaacacagcactgaagttgtgtttgttttttttttttcttgagacggagtcttgctttgtcgcccaggctggagtgcagtggcgtgatctcagctcactgcaacctctgcctcccaggatcaagcgattcttctgcctcagcctcccgagtagctgggactataggcgcgcaacaccaagcccggctaatttttatatttttagtagagatggggatttcactgtgttggccaggttggtcttgaactcctgacctcgtgatctgcctgcctcagcctcccaaagtgctgggattataggcgtgagccgctatgcccggcctagcactgaaatttataaaacatgatggtgagaaggagaaatggacaaaatcacaggagcaatggaggattttaacactttgtggcttttggcagttcaaattgaggagcataaataaatttataaagaatatcaatacgtatatttaatatggttgttaaatagaataaaataaaaagtagtattccgcacatttggtttaataaataaccaaaggaattctgaaattccccctaacaagtagctcgtgaaatagaaaaacagcccacactggccgggtacgtggctcacgcctgtaatcccagcactttgggaggccgaggtgggtggatcacctgaggtcaggagttcgagatcaacctgaccaacatggagaaaccccgtctctactaaaaatacaaaactagccgggcgtggtggcacatgcctgtagtctcagctactcaaggccgaggcaggagaattgcttgatcccatgaggcggaggttgtagatcgcgccattgcactctacaatggcaacaagagtgaaactccgtcaaaaaaaaaaaagcccacaatggcaggctatagagacaatgattacactgacagtactatccctcaaaacctctggggcttggccaaagtgatactcatgaaaactctcaccttaagaaatgcaattactaagcaagaaagaataaaaataaatgtgaaacattcaatctaagaaatcaggagaagaacaataaaataaacacaagaacaaaaagagaaaagatggaatgggaattacttctggtcaagatactgaaaccatccagtggttccagacagcgacctttgaggaaacccctggaaagggggaggggtgctcttacacacacacaggcacacacacacaccccacacgtgcacacaccccacacgcgcacacaccccacacgcacacacacgtgtcagggagcacgtctgacatgccccgtaagatctccagaagagattagacagaaatggaagaaagcagtgtttgaaaaacaatgactgagaattttaaagaatagaaaaacaaccagccaaccaacctaaaatttggtcctaaaatttaaaaaacatacagattcctgagcaggattcagggaaacaaatccacacttagacacaacaatggtaaaacaggagcacctaacagattgggagaaaagtctaaaaacagcttccccaggccgggcgcagtggctcacacctgtaatcccagaacttcaggaggccaaggcgggtggattgcttgagctcaggagttcgagaccagcctggccaacatggtgaaacctgtctctactaaaaatacaaaaaaaaaaaaaaaaaattagctaggctgaacccgggaggtggagtttgcactgggccatgatcatgtcactgcactccagcctgggcaacagacagcaagattccatctcaaaaacaaaacaaaacaaaacaaaaaacagcttccccaaaggcactgagatcagactgatggctgacctctctgaagacataagaatattatcttgaaaagaagttgagccgggcatgatggcatgcatctgtagtcccagctacttgggaggctaaggcaggaagattgctttagcccaagaaatagagactatagtgagctacgatggcaccaccatgccagcctgggtgtcagagcgagaccccatctcttttaaaaaaaaaagtagtagaaaaatgtcaacatacagaaaattctatttccagctaaaccatcattctagaaagtcatctacagatacatagcatgtactccccacagactcttgctgaaggaactgacaaagcaaagggcagagatccctgaataaaagtccatttcccttttctctttcctagaaaagatggggctgccttgtacctgagtctgagtataaagccttgtgtccgatcaactgctctccaggctcctggaagaccccactgtggtaaacagggaaccgaggtcaaggagcaggcctgggaagagcttcaatcaactgtttcataaaatgtgagcaaaagttattacttccaactcaatatattgttataagattttaaatacgtacgtgtcatttaactaataaattaaatgtaaatagatactttactatttatgcacatatgcctaataaagagtattgagtcagctgccaactattgggaaacaacaaagcgagatccctaatttgttctttttcactagatcatttcccgatgcattaaagactcagcaggaaaatgacatgacgataaaatacaagtggccccacagtaagccccctacatacacacaaaattaaagaagcacaaatttaaaacaggaaatccttttacctatttagattggccctccaaatcaattttatttcttttctttttttttttcttttttttttttttgagacagagtctcgctctgtcacccaggctggagtgcagtggcttgatcttggctcacagcaaactccacctctcgggttcgagattctcctgcctcagccgcccgagtagctgggattacaggcacgtgccccaacacttggctaatttttttttttttgtatttttagtagagacggggtttcatcatgttggccaggctggtctcaaactcttgacctcaggtgatcaggcggtggctcacacctgtaatcccagcactttgggaggctgaggtgggcagatcacttgaggtcatgagtatgagaccagcctggccaacatggtgaaaccccgtttctactaaaaatacaaaaattagctgggcatggtggcgggcgcctgtaataccagctacttgggaggctgaggcaatagaatcgctggaacccgggaggcggaggctgcagtgagccgagatcgcaccactgcactccagccttggcaacagagattctgtctcaaaaaaaaaaagttagctatcataaagaagtttactagaaacaacattttaaggaatcccagctttctacaggatcaaggaaatgccatgtgcagctgatttctggaaggcgcagagggagggtgagctccaggcactgcccactctgtgggcagaggggcctgcaggcagggtcccacagcacctgcctcctgcttccccctgcaggcccctgagtggggctgttctcactccccgccctggtctcggccggaaccctgtagcaggcaggtgaagctccttatctcagagggggcccaccatgtcacctgctggagttggctccacagtctgaatggggtgttggcaggaaccagtgtcaccagagcacaggggacgccccggcacctccccccacagccatctatatgggcaccggcagcatgagacaggctctatgcctgaaagcagccgagagccagtgaagtggcggtcagcttgctccctgcgggatgcggccccttcccagaggcggacaggtgaggacatgcactgaggcagctgcaggtgacccctgggccaccggtgctggggcagagtagctgttgtgaagtggactagagaagcatctagaaacagccacaggcagagcaggtcctgctcagccccctggctggacggctgtcccacgttgaataatgatgatatgtttgtcacagctggccattctgtactacttaatgattgcagccacatcatttatgaaccggataagtgatcttaggaaaaaaatgcagatagaccagtcagtcttgcctaaacctttgcaatcaggactcatcttttttatttttttaaatgtttttagagactggatctcctgtgctgcccaggctggagtgcagtgattattcacaggcaggatcatacccactgcagccccgacctcctgcgctcaagcaatcctcccacctcagtctcccaagtagctggaacttcagacacacaacaccatgcccagctaagaactcaatgtttaggtggggaggacggccttcccaaaaagaaacaaatggggtatgtttggtataatcaaagccaaaccaaaagtccccattcttctcttctcactctactttcttctctaaattgccaataaatcgacaaacttccattgagtcctccctatggatgtgtgcatgcatgcacacacacggtctaacatacaaatgcatgtgtgcacacagtctcacatacaaatgtatgtgcacagtctcacacacaaacgtgtgtgcacacagtctcacatacaaacgcacatgcacagtcttgcacacaaacgcttgtgcagtctcgcaaacaaacgtgtgtgcacacacacagtctcacatacaaatgcacgtgcacacacacagtctcgtctcgggaagtgctaggattacaggcgtgagccaccacacacagccgaggaaacatctctttagccagatttgggcctggcgacataggaactgaagaaggcagaaagtatctggcactcagcaggggctcctctactggatgggtggatggatatatggatggtaggtggatgagtgactggatgattggatggatgggtggatgggtgagtgaaaggatggataggtgggtgggataagtggttggataaatggatggataggtgggtgcatgggtaggtggatggatggatggatgaatggatagatggatgaatggatgggtggatgcaaagatagatgaatggatggatgaatgggtgggtgggtgggtggatggatgggcggatggatagatggatgggtgggttggtggatgagtgagagtggctaattggatacatgggtggatagatgaacagatggatgggtgggtgaatggatggatagataagtgggataagtggttggatggatagatggataggtgtatggacggatggacaggtgagtgtgtgggtaggtggatggatagatgggtgggtggacggatggatggatacattaatagatggatgggtgggtgggtgtacgaatggatggatggatgggtgggtggatggatagatggatggatgattgggcgggtgggtggatggatgggtggatggatacatggaagggtgggtgggtgaatggatgaatgggtgggtggatggatggatggatagataggtgggtggatggatgggtgggtggatggtagatggatggatggatgggttggtgcgtagatggatagatggatgggtgggtgggtgggtgaatagatgaatgggtgggtggatgggtagatggatggatggttggatgggtgggtgaatggatgaatgggtgggtggatggatggatggatagataggtgggtggatggatggtagatggatgggtgggtgggtggatgggtagatggatggatggttggatgggtgggtgaatggatgaatgggtgggtggatggatggatggatagataggtgggtggatggatggtagatggatgggtgggtgggtggatggatggatgggtgggtagatgggtggatggatggatgggtgggtgggataagtggttggatggttagatggatggatggatggatggatggatggatggatggatggatgaatagataggtgggtggatagatgggtgcgtggatggtagatggatggatggatgggtgggtgggtagatgggtagatggatggatggatggatggtagatggatggatgggtggatggatacatggatgggtgggtgaatggataaatgggtgggtggatggatggatggatggataggtgggtggatggatgggtggatgggtgggtgggtgaatggatgaatgggtgggtggatggatggatggataggtgggtggatggatgggtgagtggatgggtagatggatggatggttgggtgggtgggtgggtggatggatgggtgggtggatacatggatgggtgggtgggtgaatggatgaatgggtgggtggatggatggatggatagataggtgggtggatggatgggtgggtggatggtagatggatagatggatgggtgggtgagtagatggatagatggatgggtgggtgggtgaatagatgaatgagtgggtggatgggtagatggatggatggttgggtgggtgggcagacggatgggtggatggatacatggatgggtgggtgggtgaatgggtgggtggatggatggatggaaagataggtgggtggatagatggtagatggatggatgggtgggtgggtggatggatgggtgggtgggtagatgggtggatggacagatggatgggtgggtgggataagtggttggatggttggatggatggatggatgaacagataggtgggtggatggatgggtgggtgggtggatggtagatggatggatgtatgggtgggtgggtagatgggtagatggatgaatggatgggtggtggatggatggtagatggatggatgggtgggtggacggatggttgggtgggtggatggatggatgggtgggtgggtagatggatggatgggtagatgggataagtggttgcatggatggatggatggatggatgggtggatgaataaataggtgggtggatggatgggtgggtggatggcggatggatgagtgggtggatgaatggatgggtgggtgggtagatgggtagatggatggatggatggatggggggggtgggtgaatggatggatagatggatgggtggttggatagatggatggataggtaggtgggtggatgcatggaggaacagatggatgactcactgaaacactcagtcataaagccagtgccccttgcctttcttaggaagtcagctccggtgtctgtgtccaagatgcccagcctccacctcagtcaggagacactgctgcctttacctggagaagtctgcggccatcttcgctgctcaccacagagccgcacagaaatgccggctgctttgctaacctgcggtgttgttctcacaaatgctgccagcgaagtgggtccccagagcgcccgcagctaagatgaggtcctgctctgtgcagtggcctccgaccaggccccgctcacaagaggggcttctgtgctccttcgggccttcctgagaaggctgcgtccagagccctcccactgaccccaggcgcacacccagaacctgacccgcacccagaaccaggcgcacacccagaacctggcccgcacccagaaccaggcgcacacccggaacctgacccacacccagaaccaggcgcacacccagaacctggcgcacacccggaaccaggagcacacccagaacctggcgcacacccagaaccaggcacacacccagaacaaggcccacacccagaacctggcgcacatccagaaccaggtgcacactcagaacctgacccgcacccagaaccaggcgcacacccagaaccaggcgcacacccagaacctggcacacacccagaatgtgacccccacccagaaccaggcacacactcagaacctggtgcacacccagaacctgacccacacccagaaccaggcgcacacccagaaccaggcgcacacccagaacctgacccacacccagaaccaggtgcacacccagaacctgacccgcacctagaaccaggcgcacacccagaaccaggcgcacacccagaaccaggcgcacactcagaacctgacccgcacccagaaccaggcgcacacccagaacctggtgcacacccagaaccaggtgcacactcagaacctgacccgcacccagaaccaggcgcacacccagaacctggtgcacacccagaaccaggcgcacacccagaaccaggcgcacacccagaacctgacccgcacctagaaccaggcacacacccagaaccaggcgcacacccagaacctggcacacacccagaacctgacccgcacccagaaccaggcgcacactcagaacctggtgcacatccagaacctgacccacacccagaaccaggcgcacactcagaacctgacccgcacccagaaccaagcgcacacccagaacctggtgcacacccagaaccaggagcacacccagaaccaggcgcacacccagaacctgacccgcacctagaaccaggcacacactcagaaccaggcgcacacctagaacctggcacacacccagaacctgacccgcacccagaaccaggcgcacactcagaacctggtgcacacccagaacctgacccacacccagaaccaggcgcacactcagaacctgacccgcacccagaaccaggcgcacacccagaacctggtgcacacccagaacctgacccacacccagaacctgacccgcacccagaaccaggcgcacacccagaaccaggcgcacacccagaacctgacctgcacctagaaccaggcacacacccagaaccaggcacacacccagaacctggcacacacccagaacctggcgcacacccagaacctgacccgcacccagaaccaggcgcacactcagaacctggtgcacacccagaacctgacccacacccagaaccaggcgcacacccagaacctgacccgcacctagaaccaggcgcacacccagaaccaggcgcacacccagaaccaggcgcacatccagaacctgacccacacccagaacctggcacacacccagaacctggcacacacccagaacctgacccgcacccagaaccaggcgcatacccagaacctgacccgcacccagaaccagatgcacacccagaaccaggtgcacacccagaacctggcacacacccagaacctggcacacacccagaacctgacccacacccagaacctggcgcacccccagaatctgacccacatccagaacctggtgcacccccagaatctgacccacatccagaacctggcgcacacccagaaccaggtgcacacccagaacctgacccacactcaggccatggcctccacttcccggactcactttcgggtcggcccagctctgcacggagcctgttccccatctcgatgagctgctctttctccaggcggaggctgatgatttttctggctgcctccttcagctttctctggagtcggtgcatagataaggtctggggggcacgtgccactgaccggaggtgcaggaaaagctccccctggtcctcggcctccataggccctctcttggtgaggccctgtaacaaaactcacaggcagacacccctgtgaggctgccctcatgggaggacgccaggggtgcccacccaaggagcctcttcacctgctcttccagggtgggcactgctggctgtcactgggtgacatccttccaaaagaaagacaaaaagagtcgctgctcccagtgcttcagtgggttccttctcttccacaaatagaataaaggcccacagatctcccaggccagggtggcccccagatctcccaggccctcacagccctccgcctcctccccgccatccctgccttctggtcatctatgcctttgtgtctttcaagtgaacacaaggagaatctgaggacacccaaccagcacagcagctccccagggagagcagagagaaggctgtggcctccagcagtgcccaggacccaggaaggcggcccagggagagcagagagaaggctgtggcctctagcagtgcccaggacccaggaggacagctcccgccagcgtggcttggccctcctccactccttggggtccctcctttctctacctgccagctggacaccccacaaccaccctgcaggccggctgtggcttccctcctgaagcaggtgcagggggagcacaaaggcagtggagagggaggaggccgacacaggggcaggagctggctgggctcccccttagcaccccaagcctgggtcaaccctagatctgagcccctgggaagcactgtgttgtcctcactcagcccaacctggacttgcagcccacatcattccagtgctacagagtgcaatcccaacacaaagggatgcctggaccaaaaatgggggcacaggaaaaagcagtagtgtccaggccctggcaagacgggagccgacgacctacttctcccgtgccactcctggcccctgtaaggagccaggctgcacctggccctggccacatgagctccgagttcctggaacaggccagcacaccctgtccccgccagcttcctggtgtgcctttccagggctggcaggtgctgctgccttccaggtgctgctgttctttggatggcctggggtgcagccactgtatgcagtgcctccgggcatgtgccgcaggttcatgtgggacgctcgggggccgcgggggatgacacatcgaaggggagagatgtctgctttcctcttggacagagaaagttctatggtgccgcaggccccagctgaggacgggtgcagggcagcccccatgaaggctcgccacaggcctgagcccgagtccagactcgcttcctccagtaagcgggcctcatgcctgctccgtgagcacccttggcaagtgtggtgcagaggctcactcaccaccctgggagaatagacaggaatgggctcttgggtgtgggagaggccaaggcagagggagaggaagggaggcctgtgctggtaaaacagattgcagatggcctggggctgggggagaggggccaggcaggtgagactcgcaagtccggttctaaaaccctggatcctctacaggaacacactgggttattttgttattttaactgaagaaagaacaatcccgaaaacagattttgcaaacctcaaaacacttagagatttaagagaaaattccgtcttcaaaagcagtcccctctccctgcaaagttacaccaggccctgcggctggtgccaggcttgaggggcactgaggggccttcttgctgttgaccccacaggcaaaggaaggagggcatggatcacagggcccatgtcctagtcacgtgattctgcacacagtgacctggggggcagggagtgaacgattctacttctctcggattcagtttctggtaaaatgttatttggtaaaagtttattttgatgattctctaaaatctttccacaaaataagatttctacagcctgagacatattcaggaatgtcttcaccactgtgtgctccaagggctgcccacccccagcagggcagcagcagctgtccacccatctgcccccacgcctaggactgccccagcaccccacaggtgaggaggagatgtctccaagtatctggacgattcgaagaaaattcgaaggaaactttggtctgctgaaatgtcttcacgtcctgaggacatgtatgagtgagtgacacagggaagtccttctcagaggctgaggcctgggcctggtacagtgggttccatcaggctgggccggcgctcaccgccccacacagccactccaacgcctctcggcagagccagcaccaacaccatggccaacactgccccccagtggacccagggatgtaacacatcccccaactcagccctggcggccagtgactgggggaagttttgtattttaagggctagaggcagctgatgtgggtggtgcagtcagggaagcccaaagccaggctgtgcggctcagcccagtgggacctgcctgggagcagagtgccccactgttgtccacaggctctccctctgccatgggagaagtgggaacacgtgcctccgcacacacctggtcccagctttgcagacctggctccttggctagggccgtggaaggggaccagctttcgtcaggagtgctgtgggacagtccctggacccctgtgcacttcctcacccaccctgcactggcttcctgcactacaggaggtaggctggagacgcagtgccgcgtcacacctcagtacttgggtgggtgtacacaatacgtgacctggtccgtggcccgtgtgcaaatgtcaccaaccgtccagataacgccctgacgccatctctcctgtgcagggtccagggtcccacgtggcatttctacactgtctctcctgtgcagggtccatggtcccacatggtgtttctacagatgatgccctgacaccgtctctcctgtgcagggtccagggtcccacgtggtgtttctacggatgatgccctgacgccgtctctcctgtgcagggtccagggtcccacgtggcgtttctacggatgatgacttgatgcccgtctctcctgtacagagcccagggtcccacgtggcgtttctacagatgatgccctgacgctgtctctcctgtgcagggtccagggtcccacctggcatttctacatggggtctcccaggtctcctaactggagtggctccccagcttccatgtttgggcactcgccaagcatctagacccgctcatctgcagatgtccctctgtttgggcttgcctgaggtctcctcatgcataagctcaggttctgcatttttggcagggaccccgagcgcgagtctgtgccgtctcagtgcgacccgcccagaggcgcgtgacacgggcgcatcccagcactggcgatgggagctctgatcactcgggtcagctggggtcaaacaggctgctccactggaaagccagcatttcccttggaaataagaagtcacgtgtggggagatgctgcttcgcatccgtctgatgggaatccctctggttcagcacccatccgtggtcgcccggcgcgccgttcctgtcgcgttccttggctggcactctcgcgtggaagagtgccccgttcccctgaccgatctgtccattgctatcagcctggacccatgatttcctggttgagtcagtggattgtggtcttcaacgtcactgcctattggcctagttctggtccttggggacccctttcagctgcttcctgtgccttccgaacctgcctccatgctagagcccgggctcctgtgagcagggcaggaaccatggaactagcgcctggaactgtggaactggcatctgctgtggctgagtccgggctgtgggccctctcaggacagagctgggatcagatgcacatgcagctctacccacttctctctatacccaacataacggacacattgatcctctacctgagggtccagccccaacatggccccttctccgtctgggctcctttcccagcagcaagcagcaaggacctgggcccgccctcgtctccaggagctcagccatgctgcttggcagaggacagagcccaggtgggcctcgcctgggtggagagcccggccacaggatgctcagacccaggaggagcctggagcccgactgtcgcctccatgcatgtagacacagagcctggagtgtatgccccgcctgtgccttagctccaataactgggattgggctgcaggtggcttcatctctcaatttaaaattctgcttatttgggccaggcacagtgggccactgtgcctataatcccacctgtaatcccaccactttgggggactgaggcaggcagatcacttgaaaccaggagtttgagaccagcctggccaacatggtgaaaccctgtctctactgaaaacacaaaaattggccgggcgtggtgcacctgtaatcccagctactcagggggctgaggcgggagaattgcttgaacccgggaggaggaggttgcagtgagccaagatagcgccagtgcactccagattgggcgacagtgtgagactctgtctcaaaaaaaaaaaagaaagaaaaaattctgcttatttgtataaattcttgccccttcattctaaacaagtgggaagacagtgaactacgcaagggccaacagtgagagctcctggggccccttgctgcccaaggaggcgcccgcccgtgtccgggaacacatggcgctcaggtgggtgggagatgtgtgggggtacagacatgcttacccctggctgtgctgccagctggcccaagggccacagcccccaccgggcaggagccaccctggagtggctggactgggagcccaggagggctagggtgctggagacccctgaggacaagacctccttaccaacaggtacaggggcaggtgcagctcaatatcttaccgaccagctcagcccttcctgtgcgcactggctgagcacctgctagggcctcaggctccctcggccttcccatacctgccctgttgtacccctgaggcatccttatggtcttgcccatcccatgccaaggcagctctggcctgctcctcactgtcctggagcctgagacagccacggccgcatcttcctcagtccactctattccagcctgagtccctggggatctgctccccaagcacggtgccctggggatccacgctgtcttccactttgtgctttccagacatcatctactgtccccaaaaccttctgtggattcataggtcactattggtaactataggttaccacaggtcataggtcactacagttatcccagttaccaacagtctagggtacgaagtcagggaggccgggcagcctgtccttcacagcctttccctctggccttaggtaggaagaagggggccctgctggtcggctctgccaagctgcagaatcaggacctggggtcgtctccacagctcagagctgtggctcaaacccagccatggagttgggggtcactccctcggggccaagggcctgaccaaaaccaggataggagtgccatggcctggagcagctgtgtggctctgaacgcagcagtgagggccatgtgggcccctccccacgcagggagggcccaacgctaggcatggggcaggcatggctgtgcacgcagacgccccctcagcaggccgtcaaggccctgcattaaagcaaacatgagccaccttcagtgtgtgcgtttccaacacaagatgctgttagctgaagggaggactgggatgggcccgtcccgccccccaccaacggggcatcaaggtgaaggaccaggagaagaggaggcgtgtggaggaagaaggcggaggaatggggagagggggtggagcagggcccacttccaggcacggccttcactgcagccctcgtcccacctgagctcccagggcatacagacagcaacgctggcagagcacaggcaaggacggtttctgtggcaggaacctcggcgggtggcaggaggagctagcgggcacccacctctctcccaagggccacggcgtccgaggctgggggctgcttcctgcctgaaggctccgctcccccgtgctgggctatcctgagatgcttccccagctcagccacctgcttccgcagctccaaaacctccaggtgtacctggtccacctcacggggaagctcacgctggagagcggccggctccaggggttcccgcagcacctaggggtcatttcaaaggcagtgtgaggaatgaggcagtggctgggctggagcaggcccctgggcactgacaggaagcgctgtgagtgccgggaaagaacggggagcccggggtcagggcctcctccccagctggatgcaactgccctcagccctctgcccccaaccacggccactgctcctcctgccccgcccagctggccctggcagttcccctgtgccctgctctggactcctaggctggtggggagaatccgtgcatggactgaggcagagcgcctcgaaaccccttcctgagcctcctcccagggagaaacaaaggcctccagaattgcaagtaaccggtaggaggtgttgatttttcttttctgctaatcaaagggggcagacatggggaggccagaggtaaacaggccaggaagtcggagggctgaggctattgaaaggcaggtggataggctgggtgcggtggctcacgcctataatcccagtgccttgggaggccgaggagggtggatcacgaggtcaggagatcgagaccatcctggccaacatggtgaaaccccatctctactaaaaaataaaaaaaattagccgggcatggcggtgggtgcctgtggtcccagctacttgggaggctgaggcaggagaatggcatgaacccgggaggtggagcttgcagtgagccaagatcgcgccagtgtactccagcctgggcgacagagcgagactccatttcaaaaaaaaaaaaaaaaaagcttgtattaatttttatttatttacttattttattcagacggcatcttagttggttgcttaggctggtctcaaactcctgggctcaagcgatccttctgcctcagcctcccaaagtgttgggattacacgtgtgagccaccgcatccagcctatttctatttttagagacagggtcttgctcttcgcccaagctggggcagagtggcgcgatcgtggctcgccgcagcctcaaccatctgggctcaagcaaccctcccactgggctcaagtaatcctcagcctcctgagtagctgggactacagacgcaccaccatgcttggctaattatttcagtttttattacagatggggtcttgctgtgttgcccaggctgatttcaaactgctgagctcaaataatcctcccacctcaccattccaaagtgtggggattacaggcatgcaccaccgtgcccagccttgtttagtttttgtagggacaaggtctccctatgttgcccaggctggtctcaaactcctgggctcaagtgatcttcctgcctcagactcccaaagtgttgagattacaggtgtgtaccaccgtgcccagcctaaaagctgtatttaaatgtttatttcttgtctgtagcatttgtgcgggaaatgggggaaacagcaactgcaaagcatcggggatctggagccccttcacgggcacatggatcttcaactccctcgactggagcccctcacgtgtacatggatcttcaactgcctcgacagaaatggaaaagtggccaagttcctctccattgcaacaacaaggacacacttccaatcaaggcgaggcgttaggcatcagcagaaaatgagaggtatgagggtaacgcacatgttaattagcctcatttagcccttccagtgtgggcatgtttcaaaacatcatgtcgcataccatagagatatacaatttatatttgtcattttctttttttttttttttgagacggagtcttgctctgtcgcccaggctggagtgcagtagcgcgatctcagctcactgcaacctccgcctcccgggttcaagcaattgccttgcctcagcctcccgagtagctgggattacaggcacgcaccaccacacccggctcatcttttgtattttagtagacacagagttcatcatgttggccaagatggtctcaatctcctgacctggtgatctgcccatcttggactcccaaggtgctgggattacaggcgtgagccacctcgcctggccatatttgccattttcaatcaatccatcaaacatcttaggaagattaaaaaaaaaaagcatccaatttctggagcactgtgcactccctgggcagatgggaaatctggaatactttgtttctagagagatgttctgcgttagagaagaagcagaggctgcagggaaggcgtggtttatgtatttacaatgcgagaggacatgtggaagttcccttgttatgtcgcctcacaaggaataaaagcaacaggatgaggacagcatgactcagaagcacaagcaacaggagacatgatcaacaggactggatcaaaactggaaacattcggtgtccttcaaaggacaccatcaggaaagtgaaaagacaggccaggtgcagtgactcatacctgtaatgccagcactttgggaggcagacaggccaggtgcagtggctcatacctgtaatctcagcactttgggaggcagacaggccaggtgcagtggctcatacctgtaatcccagcactttgggaggcacacaggccaggtgcagtggctcatacctgtaatgccagcactttgggaggcagacaggccaggtgcagtggctcatacctgtaatcccagcactttgggaggcagacaggccaggtgcagtggctcatacctgtaatcctagcactttgggaggcagaggtgggaagatcacctgaggtgaggagttcgataccagcctggccaacatggtaaaaccccatctctaccaaaaatacaaaaattagcaggcgtggtggctcatgcctgtaatcccagctacttgggaggctgaggcaggagaattccttgaacccgggaggcggaggttgcagtcagccgagatcacgccattgcactccagcctgggcgacacagcaagactctgtctcaaaaaaaaaaaaaaaaaaaaaaaaagagaaagtgaaaagacaaaccacagaatgggagaaaaatgtagcaaatcatatatctaataagggacttgtatctggaatataaaaagaattcttacaactcaaataaaaagacaacccaattaaaactgggcaagggatccacacggatgtttctccaaagaagacaaatggctcaaatggctgaccaagacgcacatgagacgatgctcgacaccaggagtcatcaggaaaatgcaaatcaaaaccacagcgaggccccacttcactcccaccaggatgcctagcatcacagccagaaaacagctagtgttggtggggatgggggaaccggaaccctcacacagtgctggtggaggtaaaatcgtgtggctgctggggaaaacagtgcggtggctcctcagagggttaaacacagagttaatgtctggggaaaacagcacggtggctcctcaaagggttcaacacagggtgaccgtctgacagagcaattccgctcccaggtgtacacccaggagaactgaactctgcataagtccacacaggaacttacacaggaacattcacagcagcattatgcacaatccaaacagcggaaacaacccaaatgttgagtgcatgaatgataaacaaaatgtgattcctccatacaatggaatatgtcagccatgggaaggaatgacgttctgacatatgcagagctgaaccctgaaaacattctactcaatgaaagaagccgggcacaaaaggacaactaccataggactgtgttaatatgaggtccctacagtagacaaattgattgtgacgggggtggaatacttactagaagctgggaagcagggaaggggtgacactgctgtgtggttattgtaccgagcttctatctggggtggggagaaaagctccggtaatagtgagaatgtttatgcgacattgtgaatgtgcttaatgccactgaaaggtacactttaaaatggccaaaatgaatagtgagaatgtttatacgacattgtgaatgtgcttaatgccactgaaaggtacactttaaaatggccaaaatggtaaactttgttatatattaatgaattttaccacaattaaaaaaattttttttttgagatggagtttcgctcctgttgcccaagctagagtacaatggcacaatctcggctcactgcaacctccgcctcctgggttcaagcgattctcccacctcagcctcccaagtagctgggactatgggtacccgccaccactcccggctaattttttgtattttatagagatggggtttcaccatgttggccaggctggtctcgaactcctgacctcaggagtggggtgatccgcccacctcggcctcccaaagtgctgggattacaggtgtgagcccccatgcctggccacacaattttttaaagtaaaagccaaaacgatgttaggaatatgtagcagtcaaaccgaggtagtgaccccagccccatgggaaacagggtgggctcgctgctggatgcagatactggtcccagcaggagtaggacccgacccccaaaaggcaagggcccaggaggttgaaaagaacagcgcttgccggggccctagtatctcagatgaagtgtggctcaacactgacatggagcacatgcgtccggttgaccaggacccctctgagcgggcaggtggcatcgggcagcccgcacacacgccccactgaccaggacccctctgagcgggcaggtggcatcgggcagcccgcacacacgccccactgaccaggacccctctgagcgggcaggtggcatcgggcagcccgcacacacgccccactgaccaggacccctctgagcgggcaggtggcatcgggcagcccgcacacacgccccactgaccaggacccctctgagcgggcaggtggcatcgggcagcccgcacacacgccccactgaccaggacccctctgagcgggcaggtggcatcgggcagcccgcacacacgccccactgaccaggacccctctgagcgggcacagccagggcctggtgttctggccgccagtgctgcctccactgcctagaccatgcttcccaggttctcatggcacgccttccacgagcacacctgagatgaaccggttcctaggacctccccacagccccttcctcagaaaaaaacaggcagagagaggtcagtggatgcccgaggtcacctggggtcgcaccgggcagccgctcagagcccacgcgctctcccccagcagcggctctctaggaggatgaccccacaaacttgactgcctcaccttctgtctgagtcgtgtcaccagcaggtttaggagctgcactctgtccccgagcttcctgagtgccagtccagaggatactgggccagcttggacagatcctcctgcttgaccagcttggacagaccctccggcttgaccagcttgggcagaccctcctgcagagaagagtggcttctgtcagctcatacctgagaacaaaggaagacctttctggggagacacacatctctatcagctctccctttcccgtgaggccatggcaccagcggctgaccccaatgcgaagctgttcttcattggagtcagcagatctggtccacgtgaagattagagatgctgtacagaaagcataatcctcatgtaaagaaagcaagaatccttgtaggaaaaagtctgaccttaccacgtaatgtctgatagagaccaattgctccagtctgtccaagtaaagagccacttgcttggaaatgaagaaaaaagatgccacataacacagggtcaaagaaaaaaatcacaatggacattaacaactattttgaatggaaagataacaacaatactaccttagaaacttcaggaatgaatctaaagctgtccttccaagaataattacagctttagataaatattttagaaaagaagaaaggccaaaaaccaatgagctaaacattcatctcaagaaattagaggggccaggtgcagtggcccatccctgtcatctcatcacgttgggaggctgaggcaggaggatccctcgatcccaggaattcaaggttacagtgagctatgactgagccactgcactccagcctggataacagagcgagaccctgtcacacacacacacagaaaaataaatttaaaaagaatgaccaaattaaagccaaatagggccaggcacggtggctcacgcctgtaatctcagcactttgggaggctgaggtgggcagatcgcctgaggtcaggagtgggagaccaacctggccaatgtggcaaaaccctgtctctgctaaaaaaaaaatacaaaaattagccaggcgtggtggtgcgcccctgtggtctcaactactcgggaggctgaggcacgagaatcgattgaactcgggaggcggaggtggcagtgagccaagattgtgccactacactccagcctgggtgacagagtgagactctgtctcaaaaaaaacaaaaacaaacaaacaaaaaaacgccaaataaagtaggaggaagaaaagataacgttagtattagatactgaggaaacagaaaataaatgtataatagagaatcaacaaaatcaacagttgattctttgagaaggctaaaataaacacccaataatactaagcaaggaaaaaatagaagcaaatgaccaatataattaatggcaaaaaggagtcaacacttcagatcccacagacatttaaaaactcataggatactataagcaactttatgtcaaaaatttgaaaatttagatgaaatggacaatttcttagtaaaatataacatcaaaaatgtacaaaaaagaaaatccaaatgtcctacaactatgaaaaaaactgaatacacaattttaaaccttcccacaaggaaaactccaggcccagctggtttcaaagttgaattctaccaattatttaagaaaaattaatataagtctgatacaaacttttttagaaaacggaaaaatagagaatactttccaacatatttatgaggccagcgtaactctgattccaaaacctcccatgaacattatgagaattgaaaattatgggccagtcttactcatgaacataaatgtgataattctcaataaaacactggcaaaccaagctgggtgtggtggctcacacctgtaatcccagctacacaggaggccaaggcaagaagatggcttgagcccaagagttcaagaatagcctggtcaaagagcgagactgtgtctcatttaaacaaaaaacaaaagaagtatcagcaaaccaaatctgtcaaactataaaaagaagaatctatcactacatgttgaattcatcccagaactgcacgggcggtttaacccgacggagcccctacagtccacccgcattttgcctgctaatctcagctaaaggcccagccagaacacaaaaagcctcactaggggaaaattctgaacagtgagaaatgaaggctgagtgtctaggggcctcggatcccaggggtggctggcaaggagtccctcgtctccttcctgcacacactggcctggtgctaggcagccacaacccagagctcagaccaaaaaaaaaaaaggccgaagagaagctgctcctgggaccaacggagcaagaagacggggacgtgcaggtggagcccttgggaccacacctgccctcctgccagcccatggtcctgcagcctgctgtggacaaaggccagctgggcttctgggagagcatgtggggagggtcacaggaggaaggaggtctgcgtgaagacccctgaggagctgccgtgtaaaaccagccagaatccacagaaccagcacagcaaaacctctgacaaccgggcctggcgggggacactgcccaggatttaactggccacttggtagctcatgtatgggcagaggaaaatagcatcatcaaggctctggaaagtaatggacattcaaacctcagcccaccagagcgggccaggatgcgcagtgtgaacccagaaaggctgactacctgacaaaagaaaagacagaattaacatagatttaataagaactggaatttcataatgtgacactcaaaatgtccatgatacagtaacaaattacaggaggctgcttgtaattccagtactttgggaggccaaggcaggaggatcacttgagccaaggagttttgagaacagccttggcaatatagtgagactccatctctgattaaaaaaaaaattactcgtcatattaacaaccaagaaaatctcaatgtgaatgaaatagacaacaccaagatgacacagacattggaattatgggatgaagattttaaagcagcagtcataacaaaactccagcaagttactggggagggtagaggtgagagaattgcttgaagccaatagtttaagatcagcctgggcaacatagtgaaaccccatctctacaaaaaaaaaaaaaaaattagctaggcatggaggtggtatgtacctataaccccagctcttcagcagtctgaggcaggagggtcacttgagcccaggaggcccaggctgcagtgagccatgataatgccgttgcactccagcgtgggtgacagatcgagaccctgtctctaaaaaaaacaaacaaatacacaaacaaaaaactccagcaagcaatttaatacactctaaaacttatggcaaaatgaaagttccagtaaagtaagatataaagaaaactaaggccaactgtgatggctcatgcctgtaatccaaacactttgggaggctgaggcaggaggatcaattgaggccaggagttcaagaccagcctgggcaacatagtgatactccatctctacaaatataaaaagaaattagctgggtgtggtggtgcacacctgtagcctgtagtcccagttacttggcaagctaaggtgggagggtcccttgagcccagggggtcaaggctgcagtgagctatgaccatactaccacactccagactggacaacagagcaaggccctgtctcaaaaacaacaaccacaacaacaacaacaaaaaaaaaggaaaaagaaacccaaaatggaaattttagaaacagaaacaaaaatctcactgaatgggctccacagcaaaatggaaatgacaaaagcaagcactgataaacctgaagaacagaggaaaagaaactgtccaatttgaacaagagagaaaacaaattgaaaagaaacaaaacacagcctcagggaccagcaggacaataacaaaagaccaaacgtttgtgtcctcagagccccagaaggaaagagtgtggagccgaaaaaattacttgaaaaataatgaatgaaaacttctgaaatttggtgaaagacataaaccttcagatcaatatcaaaaagaataaaccaaagaaatctatgcccagatacaacataatgaaatttctgaaaactaaagacaaaaattcttttttttttttttgagatggatttttgctcttgtagcccaggctggagtgcagtggcgcgatgtcggctcactgcaacctccacctcccgggttcaagcgattctcctgcctcagcctcccaaatagctgggatcacaggtgtccaccaccatgcccagctaatttttgtatttttagtagaaatggggtttctccactttggccaggctggtcttgaactcctggcctcaagtgatccacccgcctcagcttcccaaagtgctgggattgcaggcacccgcaaccacacccggccaatttttgcatttttaataggggtttcaccatgttggtcaggctagtcttgaactcctgacctcaagtgatccacccacctcggcctcccaaagtgctgggattacaggtgtgcgccaccgtgcccagctaatttttgtatttttagtagatacggggtttcgccatgttggccaggctggccttcaactactgacctcaggtgatccacctgccttggcctcccaaagtgctgggatgacaggcatgagccacggcgcccggcctgtcaacgtaattttaagagttaagtgtgaaagaatgtctatcatattcatccttgccattagttttccttcactcctgacattcctagtttccttccttctgttgtgtctaaagtacctcctttatcagttcttttagatccagtctgctggtgacaaacttttccttcatctgagaatgtctttattcactctcattcctgaagaatatttttactgaatgtataattatgggttgacagttttttgctttcagtacttgaaaaatattatgccacttccttctgaggagaaatctgatgacagctgctgctgagaacccactaccgctccagtcactgtcccctgtgggctgtgcatcgctctctctgtgtgctttcaacagtttttgtctttaggccgggcgcagtggctcacgcctgtaattccagcactttgggaggccagcgcaagtggatcacctgaggccagaagttcgagaccagcctggccaacatggtgaaaccctgtctctactaacaatacaaacgccaccagctgggcatggtggcacatgcctgtaaccctagctactttggaggctgaggcatgagaatcgctcgaacccaggaggcagaggttgcagtgagccgagattgtgccactgcactccagcctgggcaacagagactccgtctcaaaaaacaagaaattcatttcaaatataaaagagagaggtaggtaaaaagaaaaagggatgaaaaagttataccacgcgaatgctaatcaaaagaaagcccgagtggattaattaatatcagacaaggtagacttcagaacaaagaatgttgccagacaaagaggaagattacgtaacaatataagggtcaattatcctaaaaaaaaaaaaccctaaatgtatacacatctaacaacaaagatacaaaatatatgaaacaaaaacaaagaatcgtgatttaaaaaataaagatctatattaaaacaggaatagaaagaaacttccttaacctccctccactacccccaccacaaaaaaccttcagcaaaaactcaacctaaaaaagtgaaatgctgaaagttcttcctctgggattagggagaaagacagctattatcaacatcataccggagagtttagctaggggcgataatgcaagaagaagtaaacaatatcagcattggaaaagaaaaataaaacctcccttattttattttactttattttttttgagatggagtctcgctctgttacctaggctggagtgtagtggtgcaatctcggctcactgcaacctccgcctcctgggttcaagtgattctcctgcctcagcctcccaagtggctgggattacaggtgcctgccaccacgcccagctaatttttttgtatttttagtagagacggggtttcaccatgttggccaggctggtctcaaactcccgacctcaggtgatccacccacctcggcctcccaaagtgctgggattacaggcgtgagccactgcgcccggcaaaaacctcccctatttgagacaatctgtgccagtggagtgtcctgtctggcccctccctttcttttcctgccttaggcctgcagatggggcctgcctcccctacactaaggggggctgtggctccagcagggtgaaggcatctgtgtggaaggcagccaggctgggctgtcaagctcggtgatgctggggaggcatccaggcaggagaggggcctgcaaataggggaaggggccacagcagcaatgggggattggttacaccaagaggactcgatcaaagtaactgtgttagtgataatgggcgagccaggtttctcattattgggaaaggaagttagaataatgaaaaagaaagctagaatgctagaatgaaccttttgatgttggactaaccacaatggaatagattagcctatgagtttgtcttgaaattaagaccttccattcaccaaagacaccagtgaaggaataaaaggcaagccatagactgggagaagatatttgcaacacatataaccaacgctaggctcatattcagcataaaataccctaaaaaaatctatgacaaagggcagatgatccaataaacaatgggcaaaagacatggcctggagctccaaaagaggggctgtcgaaaggccaattctatggactgagctctgccccccaaaatttacgggttgaagctctcaccccgaacatgactgtatttggagacagcgcctctgaggaggcagctaaggttacatgaggtcctaaggctggggccctggactgttgtccttacaagaagaggaagagtcgggcgcggtgtctcacgcctgtcatcccagcactttgggaggctcaggtaggcagatcacgaggtcaggagttcgggaccagcctgaccaacgtggtgaaacctcatctctactaaaaatacaaaaattagccgggcgtggtggcatgcacctgtaatcccagctactcaggaggctgaggcaggagaatcgcttgaacttgggaggcagaggctgcaatgagccaaaatcatgccactgcactccaccctgggcaacagagcaagactctgtcccaaaaaaaaaaaaaaaaaagaggaagagacaccaggagtgagcatgcagcgggggaggagtcacgtgagcacgcagggggagagtccacatgagcacgcaggggagagggtgccgtctgcaagccacagagaggcctcaggaggaacccaccctgccggcaacctgatctctgacatccagactccagaagtgagaaaataaaaccgttgtttaagccactcaggctgtggtgttgagttacggcagccctagccaatcatacgccaatgcacacaggaagagatgttcaatcccacgaatctcatgaatttgcaaattaaaccaaaataggatgtgctacgtgtccactagagggaacagaaggagccgctgaccacgtaagtgttggcgcgcatgcagcaccacggctacctcgcacgatgtggatggatgctttggagaagaatctggcattatcaagtgaaacacagtgtaggtctgaagacgccagacagaagcacaggtgccacagaattccattcacaccaaaacagggagcgctgactgcagtgagcagccagggcacgtgggctccggagggagcacaaggaattccattcacaccaaaacagggagcgctgactgcagtgaggagccagggcacgtgggctccggagggagcacaaggaattccattcacaccaaaacagggagcgctgactgcagtgaggagccagggcacgtgggctccggagggagcgcgaggaattccattcacaccaaaacagggagcgctgactgcagtgaggagccagggcacgtgggctctggaggtagctccaggaattccattcacaccaaaacagggagggctgactgcagtgaggagccagggcacgtgggctctggagggagcacaaggaattccattcacaccaaaacagggaacgctgactgcagtgaggagccagggcacgtgggctccggagggagcacaaggaattccattcacaccaaaacagggaacgctgactgcagtgaggagccagggcacgtgggctctggagggagcacaaggggctgctgggctggatgacgccgccccaacgtctgcagtagccttgagctgtatatttgctatgagcggacttttgcaggggtcagatttcagtttataaggggacagcaagtaccccactgagacgcggacttaccagtcgtctctgtcgaggtgcggacgctgggctgagactcagcatgaggtgaggacatctttaaaggatccaacacatcttctagatgcttttccagagttttaaacttatgctttagagttcgtatttctgcttcaagggccagaacataatctgccaaaaaaacctccagtgaatataacacatacacagcatcctttcgcacctccctcctgtgagcaccagctcagggagccgatgccagctcatgcccgccagcttcactgtccctgtcctcctcacactacagcttcaccgtagtttccacactctctgtgtgtgtcagactgaaagaccttccctcccctcactggccagagtgtgccagccagagaccagcacagtctccatgctctccaggaagggctcagtgatcaggagcaaatgctccacctgccgccagcccacgtgcctctgtgcagaggggccaagtcccatctcgagaacggaagctctgcctccatcccggcatctgcccacccacagccactcatggggtccctgggggtcgggaggccctcatcagctctgccacagacgctcctctggaggaaaggactgaggtccaccagcccctgctaccaacccattctgggacagcgcgacagcaagccagccctggtccaggtctaaaacaggtttttaagtgtgtcaagcaggtaccctcattttttccttccactttacaaatataaaagctttttggtataaaacttaagatcccttctcttggagaaaaagcagttttcatactttgagtttattacaggggatgttaacttataggactctgaaatgaagcctccttgaagccagtcaagacccatgctcccgtctgtcctcctccctccctctcccccttcctctcccgctctgtccgtttctcccacttactcaccaggagtggcggcatctcccccagcctctgggtcaggctggtttgcatctgtgctctctgccgctgtctggatgggaggaggaatctgatggcttagagcctccatttctttcctcatctgggcaatcgcgtttcgcaagctcgtgttctgctctcggagccgctggatctcactggatggaaagtctttacttatttcttcttcatgctgcctgagaagcatctgtcaaatacaaggaaaaatggctacaaaaagatgaatggttccccagcttgtcctgacaggctgtgcctccgctctccccgcgcccctctcgggccggtcccccgcttcagcttgggctgtggtccctccccatccccaggctgtgatgcccctcctttctgacagaagtgcaaatatgacactcaaattcctggagcctttcatacttttgagatccctagagtgtccaatccacagaggcagaaagtggaatgggggtgctggggctgtgggcggggagggggagccagtgtttcttggggacagagcttcagtatggaaagatgagaatgttctggagagggtggtgtgatggctgcacctccgtgtgaatgcgcttcatgctgctgaactgtgtgcaccaaaaaatagttaaagcagccagttttgcgttatgtatactttagtacaatcaaacatccactaaataggatgaagagcaggttcagagcgcgcagaagaaaaggcagtgaatataaacacctggcaacagaaaatacccaaactgaagctcagaaggaaaggtgccaaagaagaaaaaatgagcagagctctggagaccatgaacaaggtgcacaaggaaccaggagcccagatgaacgcaaagacaggagacgcgtctacaacaaggccagacatgttacaaatgtgctgaaagccacacatcacagatgacgaagcaaatgagctgaaagccgacatcacagatgacgaagctcagtgaaccctaagcaggataaacagaaagaaaatcataccaaacagcacataatcaagctgctgaaaaatcagcaacaaaatggaaactctaaaagcaacccgagaaaagagacatgttaccctagggtcaaagggcaggcatagggatgacagaccccgcaaggagccaccaaggcgggaggacaacgaggtgaggtggctccggtgcaggaggagagacaggccccgcccacccagttcctagggagagggagtgtccttctctaaccaaaggtgaggggcgcttctgcctctgaccaggagggactcactgccatgagtctttccctgcggctgtgaacaactagaacaccagacacattagaggaaacacctgcttccagacgccagcatagaccccagatacgggagagggaaacaaagtcccagggtctggcccaactcaaccttgagtccagccaagatgtgtgcaaaaggcacagcttcctctcctgtggagccaccctgagggacgcagagcctgctccctactctgcactccatgaacacaaacctgaagcaagatctgggcccttcccaggacgctctgactgcccgctggctcctccgtgctccctggcaaggccagctggcctgggctcccaggaggagagcttcacacgctgcgctcaggggtggagaggatgcgaacagaacctgcacctcaactggcagtttagaaacggagacagtgcgatgcctaaccctgtttttactctaactcgctactttaaattttgccctgtttgtctctttaatcacctagccttgtttctcatgtaaataagactctctctagctgggaaagccggacaaactccaactgaccccttaatttacaagacactaagggctccttacccaacccccttccgcaaggagttgacctgtgtaagcagatcctcagcatttcaaaggagcccaattaactgataaggtactggcaccaacaacgtctgaagttcccaggattcttctcaaagagataacaacataaagccttgagttcgtgtccggcatagcatctatgtctaactataatgaaggatttagagccctgcacctggtaccgttgctttttgtaaccatttgtcttttaaattgtttatcgctctgtaaccatttgcttcttttgattcttgcatgtttttacttctgtagaattattgcctttgagttcccctccccttcctaaaccaaggtatacaagttaatcaagccccttcctcagggccgagagaattttgagcgttagccgtctctttggctgccggcttaaataaaggactcaattcgtttcagagtgtggcgtcttctctaactcgcctgggtacaacaacaggaaactgcccaccgcagtgccgtgatcacaatggcgaacaacatgaaggaccattggtaagaaaatcgctaggtgcgttatggtgtggccgcttgataaaacatgcagccatttagattctgttcgtgaagaattgtaatggcgtgggaaaatatttatggtagaaccaaaaggaagaaagaattctcctggagaaacagtcgcatgaggggtagaccctggaaggccgtgctccacctggccagttacagagcgggataccgagtgcccagaggcttaccaggctatgtcccaggacgcgctgagggtgctggctgcctggcctcactggctgagcaggcccaccacagcggcaagcaaggctcagagggctcggcagtgtgaaaggaaaatatcactaagctaaagggagaagtcaagctgggaactgctcagggcaaacctgcctcccattctattcaaagtcaccctttgctcactgagatgaatgcgtatctcactgcctcctttggagaggctcatcagaaattcaaaagaatgcaaccatctgtctcttacctacctatgacccggaagcctcctccccacttggagttgtcccgcctctgcagatggaaccactgttcatcttacatatgttgattgatgtctcctgtctccctacaatgtgtaaaaccgaggtgtgctctgaccacctcggaacacgtcgtcaggacctcctgaggctgtgtcaccggtgcgcatcctcaaccttggcaaaataaaccttctaaattaactgagacctgtctgagattttctgggttcacattttggtaaccacagggagattctgagtggagatgcctctgacctttgacaaaactcctatcggtacttggtactggaatgagctaactttatggctcaaaccaacaggacaatttgccgaggtctgggagcatcccctccagagaatccctgatctccccaaatttggtcaagatctaaagtttattttgctgtacaatgttggcagaagagctgaggcggggcttgcttgtctgacataatgtaaaagagtcttggaacatgtcctgggtccagagtctaaaacccctcatgacctttggaacaccaagctctgtgccaatgggtggaaggctgccctgccgcactacagtctaagcccagggcataaaacccctcgtggcttggagagaacccagggcccagggcataaaacccctggtggcttggagagaacccagggctcagggcataaaacccctcgtggcttggaaagaacccagggctcagggcataaaaccccttctagcctctggaattgtgtccagacttgctggccccttgctccttgctctcccaagatcataaattgattttatcttgaattagaagaacctgttctcccttacctcaagtagcggagcatatgcgaaaccgtcacagctacgcttgatgcaccgctacctttctacccctacgtcctcacgccctcacctgtctacccccacagccacacgtcctcactacctgcttctttacttgattaccaataaacagtgtgggctcccagagctgggggcctttgcagcctccatacaccagcgtgggccccctggacccaccctatgtactcttgtctcattcctttgactctgctggacttcgtagcccccatgacctggtgttgggtctgatcaccccaacggtacaactccctttttttggagttttacttgcttccaacaaggaaggcaagtttctcctgcttcatgatgatggaaggcaggtaactcctttatggagtttgcactcacttccaacagggaagatgagggttttttttttttttcctgcttctaggatggtagagagcagtctttagcctgagacctatccctaggtaagtaactgaattggcatttgccttggctaaagttaagattagcaaccaggccgggcatggtggctcacgcctgtaatcccagcactttgggaggccgaggtgggcagatcacctgaggtcgggagttcaagaccagcctgaccaacatggagaaaccccatctctactaaaaatacaaaattagccgggcgtggtggctcatgcctgtaatctgagcgctttgggaggcttaggcaggcgaatcacctgggtcaggagttcgagatcagcctaacatgcagaaaccctgtctctactaaaaatacaaaaaattagccaggcatggtggcacatgcctgtaatcccagctactcaggaggctgaggcaggagaatcacttgaacctgggaggcggagggtgcggtgagcagagatcacaccactgcactccagcctgggtgacacgagcaaaactctgtctaaaaaaaacaactccaaaaattagccaggcgtggtgatgcgcacctgtggtcccagctactggagcagctgagacgggaggattgcttcagcctaggggtaggaggagattgcagtgagctgagattgcaccattgcacttcagcctgggcaacaaagcgagaccgagaccgtgtctcaaaataaataagtaaaaactacatgaatgaaggacgagctaggaacattcttcataccacttaggatctgagtcctaagtacactcggctgccttaagccaagcctcaaggcagagaagcaaattgaatgggagagaatgcgcaccagtggctggccgcttagtgcggggaggtgggaccagcaggggcagggactcttgggtggtcttgttggggtgggggtgcttgggcacacttacatgtcggctgcactgacctgtgcactccaggcctgcgcgttctactgtgtgtacaatagcccacagaaaaaagccaactgcaggcctagggcagtcctcccgtgctgggccctctgtgctctcccccagcctcctacagccctgcaccccgcttccctctgcctgtggacccagctctgctctgatgagctgtgacagctcagacaagctcctcagtgtccccatgtctcagcggacatggtgccaacctccaagatgaaatgagtggagggatttcaaggcctaagggcaaaccctggcattggatgagtacttaactatcggccactaacgtcactgctcaacaaaatcaggagcggtgatgacagattcctagcataaaatgacctgctgtgacagtcctgaggcaatatcataagaacaaactcacatgaacgtctgatatctagttatatgtggatttgggacttttaaaactttcgaatatgaaagatacaaagaagcctgagttcaccttaactctctaaagcttctgactcacccttgtttgtgcaacaggtcatttaaaaagaacacaactgaaagacttagctccagtcttggtaggatttggggatctggtcctattttcccaccgctgctgttgagcaaagtttcaaagagccgactgggtactctcacctgtgcccctggtctggggagcccatgcatcctcagggcctgcacggcctggtctcgttccagggtcacggccttcagcaccacctcctgctcctgtagcgcctgctctgtctcctgcagcttggcagcaacctgggaaaaacgctgggactcagtccctgtgtggatgaccgggcagctcccatgcctgctgaggctccaatggcacacataggtgggagatgctcagagcaccaggctccccactgtggccaggccgccaaacccttcctgcccatgcataccccaggctgcccttgcaggccagcggggatcatgcagcgctactcaaaccacgcggctggtcaactacagaaacagcttatgcaagaaagtcaaggcgggtggacaggcggggtgcatttttattactctaatttattactctaattactcagtgaggtttagtgttttcaaatttaaagaaccatttggtaagaaccagacccgtcctgcccagccccacctctgcagagacgccgagaaggccccaggccctggtggccgcacacacctgactttttgccatgctcagaccctgaatcagggcctctgacttttggatctggtccctttcaatgtcatcacagcggcgctgccagtccaggcccagctgcacctgatcacgctccaggctccgctccctttccactgccagggacagctgttgcttgtacctaaggacacgtccaaccgctcagcattaatgcttcctgaggtcccttccacaggaaaagcagaggcacgatgggaaaggcagggctgccgctgtccctcctgctctcgcatggcctgcgctgggctgacatgctcccgagctcctgtggatgggcacactgggacgcccaatacaaagacgagcaggcgccaaggatgcccagatgccggagaaaacccaacaccatggatgagggtgatgcccacaaaaccagaagagccagcatgcagggagagggaggaaagcaacaaccttaaaagatcataaacgcggttatgcacaaaggaacggagctatgaaagcaaacaagcagaccagggtggacccagccacggggtgggcagggctgggagagcccccagagcaagtgcagagcagggtggacccagccacggggcgggcggggatgggagagccccccgagcgagtgcaaagggacagaggggtgggaacgcaggaacccgggggcttcctccagaaaaccagcgcacagatgagaatggaaggaggaaaccaccaaggatgtaaaggggcaggtccaccaggacagagcaaacgccagccttcagagagctctagagatcccacacgcacacagtaaggggaaacgttatagtatgaaggacgaaagaagagtctacaaggaaaaaagaacaagaattggactaggactaggctttacaccagcaactctgggacagaaggccatggggccacacactgggggcagaattccaggctgtgggtgatcctgtgacgggggagaggtccctcctgtcccaggcagcgacacagagatggtggcatggctctgcgtgagactggagggagactctcctgctggcctcattgcaccggtaaacttcagggagttcgaatgatagcaattgagccaccgtgttgtgagagggtccctggaggggctgcgtggccaggactgaggacgccgctagggtgcagagtgaccctggctgtcagacagtgagggaatggaggccttggccccacagctggagggactgaattctgccaacagctgggtgagtctggaagggaccctgggcctccaaggagaggcaggcctggccatcattgattccagcctggagagaccctgagccgggaatggctgagccctgcccaggccctggccccagaacctgagataataaatgggtgtttaaagcagctaagctgctaagtttgtggtaatttatacacaatgtgttcttgttttgtttaattatttttaggttttttttggatacagagtcttgctctgtcacccaggctggagtgcagtggcgtgatgttggcttagtacagcctccacctcctgggctcaagtggtcctcctgcctcagcctcttgagtagctgggactacaggtgcataccaccacgcctagctaattttttgtatttttagtagagacggggtttcaccgtgttagccaggatcgtctcgatctcctgacctcgtgatccgcccgcctcggcctcccaaagtgctgggattacaggcgtgagccactgggcccagccccacagatacatttttaaatccctgtaactgcaaaaataaataaatctttaacacaacacagcagctgtcaccatgcctatcttcccactttaaacaactgggacactgggcagtaaatggggcacggctttcacagagcgaacgatgaacacacgagcggtgcggggctgaggcccctcagagaaggtcctcgcgagatgggcccactcgccgcccggcttctctccacaggccattccggatccccgcagggacggcaaaccacgcagagcacggtggtcttgctgtgacgaggagatgaaggttggagtttggagaagctgaagtggctgaaatgggctttatgaggcagaggggcagagaggaggggaacctgggatctgtgcagggatcccctagaagctgtggctgacagccacatgcaaatacacaggagaagccaacaccggctgggccaagagcaactcgtgggaacgaagcagccagcacggggctccacgtgcgctgattcccagagctcgtcagggcggccggcggagcatccttggagctctcgctccagggcacgcagtggggtctgggagtcatagtgctgagtcagccctggtgaaaaggcttctctagacctgccccacctgccctcgcactgattttaaacaagtctcaaatgggtcaagctgccatgtaaatacttaactgcagccaaacaaaaaacagcacagccaaaaccagatgctcgccaacatcatattcaccatgtctgacatccagtgaaaacttaccagatgggcaaggaagtagaaaaaaatgtagctctctccagtagaaaaatcagcccatagaaacagactcagaaataaagatatgatggaattagcagataaatacatttaagcagctattacaaataagttcagagatttaaaggcaaccgtgcacataatgaggagagaaattaaatgtataaaaaagtctaaatattgtaatatgtgctgttttctttcagtgaatggaagagtttaacgaagaaggaacattggaatcaagagttgagaacataagccaggcggggtggctcacgcctgtcatcccagcactttgggaggccaaggcaggtggatcacctgaagtcaggagttcaagaccagcctggccaacatggtgaaaccctgtctctactaaaaatacaaaaattagccaggcgtggtggcgcatgcctgtaatcccagctactctagaggctgacacaggagaactgcttgtacccaggaggtggaggttgtagtgagctgagattgcgccactgcactccagcctgggtgacagagtgagactccatctcaaaaaaaaaagaaaaaaagttgagaacattatcacagcatgttttttttcttctgcattagttcatattatgagggttttctacatacacaagtaataggtaaatctaaatgtgctttcttgaagatacatgatgttttatttcagtcaatggaagtatttaacaaaaaaaaaaaagaatgctggaaggaagagctaagaacgttattacaacatgtttctttcagcattggtacttttcctttttttttttttgagacccagtctcgctctgttgcccaggctgaagtgcagtagcaccatctcggctcactgcagcctccgcctcctgggttcaagtgattctcctgcctcagccccccgagtagctgggattacaggcgtgtgacaccacaccgggataatttttgtatttttagtagagatggggttttaccatgttgtccaggctggtctcaaactcctgacctcaggtgatctgccagccttggcctcccaaagtgctgggattatagatgtgagccaccgcgcccggcccaccaaacatttatttatattttattttttatttgtttattcatttttttgagacagaatctcactctgctgcccaggctggaatgcagtggcacgatctgggctcaccaaaacctccgcctcctgggttcaagtgattctcccacctcagcctctggagtatctgggactacaggcgtgagccaccatgcctggctaatttttgtatttttagtagagacggggttttaccatgttggccaggctggtctcgaactcctgacctcaagtgatctgacagccttggcctcccaaagtgctgggatgacaggcgtgagccatcacacccggcccaccaaacacttttaaaccatcagaactcacttactatcataagcacagcatcggggaaaccgcccccatgagccaatcacctcccatcagggtcctcccttgacacatggggattacaatttgagattagatttggggggggacatagagccaaatgatatcatacagcatacacattcatcaaaattcatcaagtgtagagttaaaatggatgagtttagcatatgtattctgtaataaagttgacttgaatgtgtatgggaaatagaatgctatctttgttcaaggaagtgttcgccccaacggataagaaacacatgaggacatgaacaatcagacaagacagacgaggagattctttgtttttgttttcctttttgcagagatggggtctcactatgttaaccaggctggtctccaactcctgggttccagcaatcctcctgcttctgcctccctaagtgctgggattataggtgtgagccaccacgcttggcaagaggagattcttagtgcagaatcaagcaggagcacctttatggctcttattacagactgagaaacaccatcctctggccatgctccctccagcaggcggccccttctgcatgtcttcccacaccacccctgcgtgaccagacattctatctgtcttgttcactgtctttctcccccaagaaaatgtgaggccagggactcaatctgttcagttttgaatccttagtacctacaacagcacctgcccataggagaccctcaatggaaacatctgcctggggacagttacctttcaatgtcctgctgggatcgggccacctgtgccttgagcttcacctcttcttcctgcagcgtctgaatctgaaggtctctggagaccatctccttagatagttgagcaatttgagcatcccaggcagattttacagttgatgcatcttcacgaagtctaaacatagaagggaaactatgtagatgtggttctcactcactaaagttgtctcttacacagcaccccccagcaaatacacatgcgcgcgcgcgcgcgcacacacacacacacacacacacacacacacacacacacacacacacacacagctctcgagctgaaacttcctggcctagatgatgaagatggttccgcacaggaagaattaagcatccgtccacccaactacctccatgcatgcatgcatcccaccaacccagattccagctaagctcctgcagcacaccaggccatgtgccaggttcttggtgggcggaaggtgaggcatgacatgcctcccatgcccacagagcccacagtcatgaggtagcaacacctctgaccaagtcaccctcatgtcctcgccatgcctagcacagcaccccacgtgcagagacattcagcacattttcaagttgcatggtaaaataaggttctacagaacccactaaataaccttaacagcaggatgcctctgggagaattacccaaaatggaataaatttcccaagaaaatgttcgggacaatatctagagctgttaactcaggtagccacagtactaacctaggcaagatgatacctgcccacttgcatgggcgtagccctgtttccctaagagatgggaagacggcccacaagagcaactgtagcatcacacacgacagaccttcagatgctcctgtgctgatgaacttccaactgacagtgagaagcagagggtgagctggctgcccccacagaggccaccccttgtcacgaggggttaaacctagcatgagtggtgcactcaagcctggtattatatagaatggaaaaaaagccaccctgccaacagttttggacacatattttaggacagctgaaaagagacaccatcaaaggcatcaacgtttccagccatctctggcaatgtgggctgacacagaatgtgtgtttggactccttccacgctttgcgtgggtactgaagaaacagactcaccaacggcctctggtgctctgggaagcagctttatccctggaccatgagccacctaattatgagggccagccccactcccagcatcaggatggtgatgtgactctgcctggggcctcctggacagtctcccctgatgcacagtctcaggtgtagatcaatgggcacggctgctgagccctcactgcagggacagaggacaccacggccacgagcgggagtgcactgctcaccacaagagcgtaaatgctttttgtgagaagccaaggtggaaggatcacctgagcccaggaggtcgaggctccagtgagccatgatcgcactgctgctttccagtcttctctttcttctgcgtaatgggatggttaaaataaaaaagaaggctgggcatggtggctcatgcctgtaatgccagcactttgggaggccgaggcaggcagactgcttgaggtcccagagctcgaaaccagcctgggcaacatgactaaaccctgtctctactcaaaatacaaaaattagccgggtgtggtggcacgcacctgtagtcccagctacctgggaggctgaggggggtggatcacctgagcccaggaggtgtaggctgcagtgaaccgagatcacgccactgcactccagcctgggtgacagagtgagaccttgtcacaaaaaaaaaaaggaagaaaaaaatgctttcctgttaatcctacaggttttctctgtagttccaaactccaaaccagcacaaaactgctgaaaaacctattaagaactacaaagctggccaggcacggtggctcatgcctataatcccagcactttgggaggctgagatgggaggatcacttaagtccaggagtttgagaccatcctgggcaacatggggagaccccatctctacttcattttaagaaagaaaaaaaggaactgaaataaatatggctgtcacttatttctatttttttagttaaaaaattatttttttagagacagagtcttgctctgcctcctgagtagctaggactataggtgagcaccaccgtacctgtctaacttttctttgggtagacatagggtcttgtttcgttgcccaggctcaagtgatcctcctgcctcagcctcccaaagtgctgggattagaggtgtgagccactgtgcctagccgaggtcatcatttaatgccagctcatacttgggatcatgggatccgaatgatagctgaactccccagaagtaaaagaggaaagatacaagctttagaatgtagaagtctgtttcttactaccaaaataatactgcatatgtgtagtaataattctcaatgagcaaagagtatttacggacagaaaacgaaaagacattcaagaacaacatttagcttaagactgcaacggggggccaaggttaggcgcacaggagtggtgacgcccagtcacctcggccgcactacatggaaaatggaagcacctgcggcccctctcaccccgtataccgaccacagaggtcgccccgcacaccgaccgcagaggctttaggtgcctcccatgcatggcgtcttcaaccactctgcttgaatctgactgatcaaacaacaacacagcatgctgaatctagagaaactatcctgaataagcccttaacttcctggtactgtgtagttctaagagccatttcccccttaaacagaaatacaatttgtcagagaattctctatcggtggtggctcatgcctataatcccagcactttgggaggtcagtgtgggaggatcacttgggtccaggagttggaaaccagtttaggcaacatggagaaacctcgtttctacaaaaaatacaaaaattagctgagcatggtggtgcacacctgtggttccagctactgcggaggctgaggcgggaggatcacttgagcccatgaggtcaaggctacagcaagccgtgatcgcaccactgcactccagcctagacaacagagtaagaccctgtctcaaaaaaagaaaaagaggccgggggcggtggctcacacctgtaatcccagcactttgggaggccgaggcagggggatcacaaagtcaggagatggagaccatcttggccaatgtggtgaaaccccgtctctactaaaatacaaaaaattagccgggcatagtggtatatgcccgtaatgccagctacttgggaggctgaggcaggagaatcgcttgaacccgggaagtggaggttgcggtgagctaagattgcaccactgcactccagcctcggtaacagagccagactccatctcaaaaaaaaaaaaaaaaaaagtcaagatgaaagaaaagaaaaagaagaaataaaggaggaaaatggttacaatagtaaattttatgttatgtgtattttaccacaatttaaaaattcagagaaaaggaaaaaattctgacacatgttaaaatgtggacaaactttgaggacattatgccaagtgaaataagagagtcccaaatggacaaatactgcatgattccaacttacaggaggtccccagcccggtcgcatccatagaatcagcaagtagaatggaggtggccggggctggtggggctcggggggagctggcaggggtcgggggggcactggcgggggtcggggggcactggtggggctcgggggggagctggcaggggtcgagagtgctgacaggggtcgggggtcactggcagggctcggcgcgggggaagctggcaggggttgcggggggtgctggcgggggtcggggggagccggcggggctcggcgttgggggaactggcgggggttgcggggggagctggcaggagtggggcagggagttggcggggctggggggagctggcaggggttggctggggagctggcgggggtgggggaggcgttggtgtgtaatgggaagatggaaagttctggagatgacagtggtgatggttttacaacaacgtgaatgtgcctaatgccactgccactgatctgtacactaagaaatggctaaaatggctaattttatgttatgcatatcttactataaatagatgaatgcacacacacatagaaactacacaatttcaaaaataaagaaaaggcaaaaaaaaaaaaaaaagagtggttaagaaaagtgactgagagctacagaagccactctgtctgctgcctggccccctttcctgtggtctggcaccagtgggcccaggtcagcacagccacggccgtccctgccctcaccctctgggtggagccaagcacacgctcactggtcaatggcagcgtccttctccttggcggtgtcagcctgtctccactctgccctgcggagctgcgcctcgagggtctcgcagtgggcctgcagctccagaaccctggtctgcagctcctgcagctgctccacgtgggctcccttcaccgccaccagcactgcatccttctccctggccagacggtcgagctcctcatgcctgaaacacagtgagtgtcccatggcgctcacccagcccccaacacccaggccccagaccctctttggaggcgttcattgccctgtctcgtgcacaggtgctgctgtatgtctgcctcaaggcttcgcagcagccacctggccacctgttcctcattcctcgcaggtaaacatggaccaagccacttttcgatgccaggcccctggcctgccctccagagcccacagccccctggagaaggacaccaaaaggaggtgcatagagcacagtttgatccgatcaacctgcgaaaggaggtgcatagagcacggtttgatccgatcaacctgcgaaagcaaaaaaaggtagatgcacactgccttgtatcctggcagccagccaggtctacggagccacaccgcaccccacctattgattttccaattagaggcaaagtcttgctgtgttgcccagcctggccttgaactcaagcaatcctctcacctcagcttcccaagtaattgggcttataggccacaccactttgcctggcaaaaagattttactttaaaaatattatgttagcagccaggcacagtggatcatgcctgtaaccgaagcactttaggaggccgaggcaggtggatagcttgagcccaggagttgaagaccaccagcctgggcaatatggcaaaacaccctctacaaaaaaatacaaaaattagcctttacggtggcgggtgcccatagtcccatttactcgggaggctgaggtgggaggaccaccggagcgtgggaggtcgaggctgcagtgagccgtgatggtgccactgcactccagcctgagtgacacagtgagaccctgtctcaaaaacaaaccacattagcaacagtattaaataaataaaaaatttaaaaagatttacgtgttgatttcctaccctctgagcatattaggttctactaagcagagtgctatcaggtatatgtaatgttatgtaagccatctcggtgaagtctttgatctaaccctactgggactgagagagtgaacagctctgctgactgggtttcagaccccttggcaaggccaaccccagctgtctgcttccaccaagttggagaagctcattcaattatgagctgatggatgatttaaaattattcctggctgggcgcagtggctcatccctgtaatcccagcactttaggaggccaaggagggtggatcgcttgaggtcaggagttcgagaccagcctggccaacatggcgaaacccagtctccactaaaaaaaatacaaaaattagccgggcatggtagcacatccctgtgatcccagctactcgggaggctgaggcaggagaattgctcgaacccgggaggcagaggttgcagtgacccgagatcgcaccaccagcctgatcaacatggagaaactgtctctactaaaaatacaaaaattagccgggcatggtggcatgcgcctgtaatcccagctactggggaggccgaggcaggagaatcacttgaacccaggaggcggaggttgcagtgagccgagattgcgccactgcactccagcctgggtgataagagtgaaactctgtctcaaattaaaaaaaaaaaaatgatgagacactagtcatctccgtgtgagcagtttgtctctccagtaaattgcatatcccagtatagagtgacctctcaaggttcttcatatcccagcatagagtgacttctcaaggttcttcatatcccagcatagagtgacttctcaaggttcttcatatcccagcatagagtgacttctcaaggttcttcatatcccagcatagagtgacttctcaaggttcttccctatttctcattgtgtttagtgtaatactgtaaaccttcaataacaccatgggacctatgcaaaggtccaccagtgatgctggaagtgagcagaggaaagtcatgcatttgcaagacaggtctgcagctgctggccattctaaaacacattaatccagtctgggtgtggtgctcacccctgtaatcgcagcactttgggaggccgaggtgcgcggaccacttgaggacaagagtttgagaccagcctggccagcatggcaaactccatctctgctaaaaatacaaaaattagccaggtgtagtggtgcatgcctgtactcccagctacttgggaggctgaggcatgagaatagcttgaactcaagaggcagaggttgcagcgagctgagattgcaccactgcaccatctgcctgggcaacagagcgagactctgtctcaaaaaaaaaaaaaaaaaaaaaaaatcttttgataatggacaatgcctcttgccacccagaacccatgagttcaacagcaaggtgttgacgtcgtctgcttgctcccagacataatgcctctaattcaacctttatgagaggccatatggaccttaaggctcactacacatggcgctctttggaaaggatgtcaatgctgtggccgaaaaccccccagaaagaagaacatcctgaaagcctggcaggcttccaccactgaagccattgttgctatagaaaaagccacggaagccatccagcccaaataataaattcctgatgaagaaagctgtgtctagatgtcgtgcctgacttcacaggatgtccaatggtgccaatcaagtaaatcatgagttgtaatacggcaaaaaaataaaaataaaaaataaaaaataaaaaaaaaggtcagggtgcggggtgaaggatttcacagcatggatcttggagaaaccccagagctgaccccacagcagaggaatgaacgggagacaactcaatggggatgagtgcttccgaaccggcgccagatgatgaggaaacagatgtagaagaagcagtgccagaaaagaaactggcatcagacagacactcctgcagaagggctcccatcactcacgcctgccttgactttttaccacgtggaactgtctatgacgtgggcactgagactcaagtgttaaagcgggattggcaccatatagaaacatttttagaggaaggaaaaagtaaaaaagtcaaatggaattacaatgtatttctgtcaagttacaccaagggtacctgcctctcctgccctcccttccacctcctccacctctgccactccagagacagcccatcctctgcctcctcctcaacctcctcaatgtgaagatgatgaggatgaagagctataagatgatctgcttccacttaacaaacggtaaacatattttctaagatttttttttaagacagggtctcactttgtcacccagggtagagtgctgtggcaccacctcggctcactacaggctccacatcccagattcaagtgatcctcctgcctctacactccaagtagctgggactacaggcgtgagctgtcacacctggctaattttttgtattttttgtagagaaggggttttgctatgttgcctaggctggtcttgaactccagagctgaagcaatccacctgcctcggcctcccaaagtactaggattataggtgtaggccaccatgcccaacctaattctacttttttatgacttttttttttttttttgaaacagagtctcactctgtcacccaggctggagtgcagtggcgcggtctcggctcagtgaaacctccacctcccaagttcaagtgattcccctgcctcagcctgccaagtagctgggattacaggcgtgcaccaccacgcccggctaattttgtatttttcgtagagacggggtttcaccatgttggtcaggctggtctcaaactcctgacctcaagtgatccccctgactcagcctcccaaagtgctgtgtgattattttaatgacattttctttcctctagctagcattactttaagaatcagcataggatacacacaacatgcccaatgtgtgttaatgaactgtgttatcagtaaggcttctggtcaacagtaggttctaagtagttaagtttttggggagtgaaaagttatatgtgaatttttgacctcatggggctagatgcccctaaccccctcactgtttaagcatcaactgtatttcaatttatgattttgaaaaatgccaggtgtagacttaaaaacacacgaagagaaacagtgtttgtccagcttcatcatggccacacggtgcagctaagcaagcagtcctgcaccactgccatctgcactgtgtctgtttgggctcgactgcctcggtttcctcatctaggtagagaacccggatgggtgccctcacaatgcgagccagctgagggcacaaccctctctcgctgccaccagtagggtctgcagagcaggctggaaagcagcttcccactgcagatctgattagaaacagcacagacagtgtccttgaagttcttctggatttatacaactgcacaaatatcatgtcaataaaaaatgcaagaaaaatcgcctgagtcactgtccatcgccgttgtattacacagtgtctttttgtatttttagtagagatggggtttcactgttggtcagggtggtctcgaattcctgacctcaagtgatccacccacctcggcctcccaacattctgggattacaggcctgagccaccgcgcccagccaggtgttaaaaattttgtgttttgttttgttttgtttttgagacagggtctcattctatggcccaggctggagtacagtggcacaatcatggctcactgcagcctcaatctcccaggctcacatgatcttcctactgcacctagtccaagttctacgttttacagcactaagaagtctaaacatcaccgagaaagtccagagcataaacagaaatccaaagcaaggctgggtgtggcggctcatgcctataatcgcagcactttgggaggccaaggaggtgggcgggtcatttgaggctaagagttcaagaccagcctggccaacatggtgagaccctgtctctactaaaaatacaaaaattagccaggcatggttgtgcacgcctatagcaccagctatttgggaggctgagacacgagaattgtttgaacccgggaggggaggatgcagtgagccaagatcacaccacggcaatccagcctgggcacagagcaagaccctgtcaaaaaaaaaaaagcaagcaagaaagcaagaaagcaagcaagcaagaaagaaaggaagaaaaagaaggagaaagaaatccaaaacagcgggctcccaggtccgatccctggagtgggaccctctgctccctgggccatcagcacaatggttccacttccctcctctcctggggccactgacatgctgcatgatgttgggagccgaaacactcacttcctcttaaatgtttcctcttccttcttcctggttagctgcacagagtgaagtttatcctctaaatcctttaccctgaaaagaaacaaatatttatggaaggagcaagtgagatgaaagcaaagaccagcctggaatgagcagaaaaggtagaatcccccagactccagtcctggcctgcgaggctgccacagagcacgcctcgggagatgaaggactcgcgcaccgggcgcggctcatggcctccaggtcctggagctccccggctcggctctggagcttcctctccagctcggcgttggtggcctctgccctctgcagactctctgcagcctttgccccggcttccttcagagcctccagctctttgtgcagtagtttaacctttgaatgataaaaatgagttcaaaatgaggtgataattagaagacactgaggcattaggggtacatactgctgttttatcaggattgggagggagaagaaaaatgaaaattcaagaagcagtaaaacagtgagaatgtcctaacacaactcaaacgagactcaatgacttttttttttttctttttggagacagagtcttgctctgttgcccaggctggagtgcaatggcgtgatctcggctcactgcaacctccccctcctgggttcaagcaattctcctgccttagcctcacgagtagctgggattacaggcacccaccaccacacccagctaatttttgtatttttagtagagacagggtttcccatgttggccaggctggtctcaaactcctgacctcaggtgatccacccgcctcagcctcccaatgtgctgggattacaggtgtgagccaccgtgcccggccttcattgaccccctgacagcactcagtaccccaccaaaatcagtctattagggtgccccatacatgtccaagcccaacagaccaatttaactgcacttcatttcttagcacataatttgaaagttatttaaataaggaaattaaacacaaagccaggggtctaggaaggggctcagtgctgagcaagccactcgcgtcccagctgcacactgagctcttcggtaccttcctgggcctgtttcccagcctgtaagccacgggtggtgacgatggctgctgcacccaagcctgctgacatgaggaccgggctgcgcccggcatgggcaggcgtcgagactcagctcttgcttttcctactgatctgtgcaccgtgatgcccaccacgggcaggtgtccagggctgtgaccaaatcacacagcagatgcaggcggaggtgaactggcacccggtgcccacctttgacgggagtgcccaccctgccatggggcacagggcatccacatggcccacctgctcgctgggcttgaactcctgggcccaagggatcctcttgccttggtctcccaaagtgctgagatgacaggtgtgagccaccacacctgaccaaggaaaaaccgaaaaaccttcacgacccaagggtgcccccagttaccttaagctcccgggacaaggctgtgttgctcatgttgtcagcctgcagacggaattcgtgctccctcttccgcattttcgattcaaactccagcagcagttcctggaacaaacaggtttcatgatgaaagaacagtgggaacccagcaaagacccccacccacgtcctgggaggtgggatccagaggtgagcaggacacagtgtttaacagagaaggaccacacacactgtccaggagagaagctggggtcagcgacactggtaacagcactctgggaggccgaggcgggaggatcgcttgagcccaggaattcaagaccagcctgggcaacacagtgaggccctgtcgctacagaaaaaaaaaagaaaagaaaaagaaaaatccttatctccattgagtcaattctacctctgacaataacaaacaccaagatcttccaaaacaagacaagaaatcagagcaaaggaaaccatgaaactgacaagcacgtaagaccctagcttagtaactaaaaggctgagatgccggcagtagaacagagcttcccgacagccagtgccagcatcccagagcccacacaggatcggactacccagaaccacaccggatgtgtgctgcccaagtttcccctagtaaccaaagctgccacgttaaaacgtcacgtttccttctttccagagacaaggatactatctgaacatgataaaaaatccatgttcccaacgtctgagatggctctccctgaacgagccctgctgagtctgagaaattcggcgtggacagcctgggaagtcagccatagtcacggcccagccagaaactctgacaagaatggctgcgccctgccaactacaaccagcctcaaatcgccactgtccccagatgctgccaagagccccccacctgctgggcaggaccacccacagctggatcctcctcaaactccttctttggaagtgactttggagccacttgaggaagcctcactacttagaaaagtcaccactggtctcttactgaccacggattttagacgctggcttcatgcctaaagaactccggctgttctcaaactcatccataatcgacaaagctctttggtttctgagaattccaagagaaagtcctctgcaggccatttcagaagcagcctcagggacctgtgaacaacgggagtgagctcagcacttccggggacaactggacagtccacaggagggcccatcatgacgtgagcgtggcctccttctctgctgacctgactgtggcaaattagtgacacactggcctatcctactatgaccaagctcccaacatccgacaggaccagagaggggaccctgtcacacctgcacaaagcccttcatcactgctgcacctgcacagacgcagccccttatgacacccccatagacacagcttctagtaacacttacacctacctgcatagacagagccatttattacacctgcacctgcagagacgcagcccctcatcacacctgcaccttcacagaagaagcccctcaggacacctgcagagacgcagcccctcatgactcctgcacctgcagagacgcagcccctcgtgactcctgcagagacgcagcccctcatgactcctgcacctgcagagacgcagcccctcgtgactcctgcacctgcagagacgcagcccctcgtgactcctgcacctgcagagacgcagcccctcgtgactcctgcagagactcagcccctcgtgactcctgcagacgcagcccctcatgactcctgcagagatgcagcccctcgtgactcctgcagagacgcagcccctcgtgactcctgcacctgcagacacacagcccctcatgactcctgcacctgcagagacacagcccctcgtgactcctgcagacgcagcccctcgtgactcctgcagagacgcagcccctcatgacacctgcagagacgcagcccctcgtgacacctgcacctgcagagacgcagcccctcatgacacctgcacctgcacaggcacagcccctcatcacacgtaaacctgcagagatgcagccccttgtcacatatgcacacagtggcagcatctctgactgtggtctctagatataaatctataggatgtctttcaacaaaaccccagcacagctgagtctcttggaggtgtaggctgagtttccagaacattgaggagaaattcggtgactgccacttttcagttgaagcatctgtttttaaacttatcataattgaattccaaattcttttccatagtaaataattcatgtttttaaaattatacctttctaaaaataaatttaaaagtttcatcatttctgaggtgtgctggttaattccatgtgtcaaatgactgggctacgggctgcccggatagctggtaaaaaattatttctgggagtgtctgcaagggtgtttccagaagagactagccctcctcctgtggatgggcgtcattcaatccactgagggcctgaatagaacgaaatgcaaggaagggtgaactcgctctctctgcttgagctgagacactcgccttctcctgcccttggacattgggctcctgcatcttgggccttcagagctggaccaggactcacatcagtggctccctggtgctcaggcctttgcccctgggctgaattacaccaccagcttcccaggttttccagcttgcagatgacaaactgtgggacttcatggcctccgtaactgcacgagtgaattcctacaatttatctcctatatatctacacgtctcctattgcctgtttccctggagaaccctgactaatccatgaggaaagaaaacaaggaaacactgtggaggtggctgcatgtagacatcccatcctgtttccctgcagaccatcccagagtggcatctgccccaaagaccccattttactcccaaggagaatgcaggcaatgaaccaaatggttgtcttttcctcagccctatatgatttcagtttcacagtgggcaggcagggaaagcacccaggaaggggccgacccagaggctctacctgtctctgcagagcaagctcaccgtcgagctcctcaagttttctctccagtgtccattttagattttcatactgttcccggtggtggtcaatctcaccattcttgtcactatggtaataaaacagcattaagaaaagccataccaaatattcagcaaaggtaatacattttcaaggtgcacttgacatgtgaaagttggtgctttgcttttatgaaggggtggcttcagcaggacccacggggtagcagaacttccagccccacctggaccagcatgctacacccatctataaaagaggaaattaaatagggcccagagtctcacaacataaaacccaaaatgtccaggatacaattaaaaaaaaaacctgacaaccaaaaaccggaaagatctgaccaggcccagtggctcacgcctgtaatcccagcactttgggaggccgaggtgggcggatcacaaggtcaggagatcgagagcatcctggctaacacggtgaaaccccgtctctacaaaaaaatacaaaaaaaattagccgggcgtggtggcgggcgcctgtagtcccagctactcgggaggctgaggcaggagaatggcgtgaacccgggaggtggagcttgcagtgagctgagatcgtgccactgcactccagcctgggcgacagagcgagactccatctcaaaaaaaaaaaaaaaaagaaaaaggaaaaaaaagaaagatctgagcttgaaggagaaaagataataggtagatgccaacaccaagatgacacagacgctggaattcttcaacaaggaagctacagcagtcattataaaagcgcttcaagtaatctagtaaagcaaatggaaaaacaaatctcagcaaagaaaaagctatagcaggctgggtgtggtggctcacgcctgtaattccagcgctttgggaggccaaggcaggtggatcacccggggtcaggagtccaagaccagcctggccaacatggtgaaaccccatctccactaaaaatacaaaaattagccgggcatggtggcacacacctgtagtgacagctcctcgggaggctgaggcaggagaaccccttgaaccccggaggcagaggttgcagtgatccgagatcgcgccactgcactccagcctgggcgacagagcaagactctgtctcaaaaaaaaaaaaagagtgtgagactgaaaaagtacctgaacatggctgaaaacatcccaggtttggagagaagaatgagcaaaagacttgaagagacacttcacaacataacgtaaagcacttttaaaaggatgctgtaaacactctggaaagcagctatgagaaagtcagcacccgcacggcgggcaagtgggcctcagctgtccaagcactgcacgcacctgcacggactcggcgcccagacgaggtgcaggctgagcaccagccttcatgctggggacgggagcttccagacaccctccctccactcagggagaagctgacctccagctcaactctctctttccctggacactgggcaggtggcacacgggtgtctaccacattagcaagcagcactgcgtgggtcaaatgactgctgactggcactttttatccacgccgcgagatgcgatagagagagggaccatcaacactgtgggcttcccagaagacggtggcgctcagggtacatctgctgcagggactgcagacgcgatccctgcgggctgctacaggagatactggctgcacaatactggttggggcttctgagctagaggggcaccacacccaccaatgtgggtctcctctccttgcacctgacctgccgcagaaggtctctctgctggaccggagcacctggtgtggtcctgttggcccgttcacacccatctgagacccttctgagcaaaccggcccaacacacacaacagagggtagctggtcagttaaaagggcgtggcagaacccagcgcactgacacgaaggacagacaccacaaatcgatcaggaagtgctggacgcacatttcggagcagtgtgcgcaggtggctctatatggggcctggagatgacacaacagattgcccgtggcggctttcacttcgccattccaccacagtatcttctctgagaaatgactttctatgataagaatagtttactcctgcggctttaaaaagtgctttaaaaagctgcttatggccaggcgcggtagctcacgtctataatcccagcacttcaggaagccaaggccagtggatcacctgaggtcaggagttcaagaccagcctgggcaacatggcaaaaccccgtctctactaaaaatacaaaagaaaaaaaaattagccgggcgtggtggtgggcacctatagtcccagctacgtgggaggctgaggcaggagaatcacttgaacccgggagatggaggttgcagcgagccgagatcacgctactgcgatccagcctggacaacacagctaaaaactctgtctcaaaaaaaaagaaaagaaaaaaaatgctgcttatgttagaagaatacataaaacataaaaaaagtacccaggatcctgttaagtgtaaacagagcatgcagccggctctcctaacgtctgtacacacgcatcacacaggaagggcctctgttaatgtgctatgatgaacctgcggtacttctgaagtgggggatggaagagcttatcagagaagcctgtcctccttccttcctgtctcctcaaactctccacagcatggctgggtgagtggagctgaggggataccaggcatgtggttgagttccaggggccccaccacaggccccacaacaaaggctttaggtttttatgtcgacttgccttaagtcagctcatttagttttgaaattactacagacttccattaaaatcattataaattcaaatatgtattaatatagatttataattaatgaaataaattccaaatattaaaaccaatctccattaatttcagagttatatcagaacccagaaaaagacagtcagggcattcctggatccatccacattaactcaacaaacacatgttcagaggccacgaggcactcggccactcagacagaccagctcccgtggcctggaatcagcagcgggaggaggggcagtgagagtgggcagtgctcgggcagcacagcggagcaggaggcatgtgggggcctctgccaggcactgcacaggagggcgcgtcggtcggtggctcacctgtggacgcgctccagctccaggcgatgctcctggaatgccagctgctgctgctgctgcagctcctccaccttcctggcctctctggctagcgcctgcctcagcttagctgcctctatcttgagctcgctcacctctgcccgcctggcctcttcccactccctggcctgggcgaaggcggcgtcatagcgctccagctcgaggtcccgctcctccagcacctgaaggttgtagacaaagtcctcctgcaggcaccgcagtttcccctgcgcctcctccagctggctccgtgtgtcctgcagagccgcctcctgcagctgggtgcggtgtgcctgcagcgccctccactcctcctccttgcgaagcagcagctcattcagggcgggctctgagcccagtggcagcatggtggccgctgcagtaaagagaaatcaggttcagggtgcaccgtgaggggccctaattttcctaccacagtacctacctcacattccctatcaacagttaccacggccgggcacggtggctcacacctgtaatcccagccctttgggaggccgaggcaggcggatcacctgaggtcaggagttcaagaccagcctggccaacatggcaaaaacctgtctctactaaaaatacaaaaattaggccgggtgcagtggctcacgcctgtaatcccagcactttgggaggcccaggtggatggatcacttgaggtcaggagatcgagaccagcctggctaacatggtgaaaccccgtctctactaaaaatacaaaaaattagcctgctgtggtggcacgtgcctgtagtcccagctactcgggaggctgaggcaggagaatcgcttgaacccaggaggtagaggttgcacaccagcctgggtgacagagcaagactctctctcaaaacaaaataaacaaaaaaaaaaggccaggcatggtggctcactcctgtaatcccagccctttgggaggccaaagtgggtgggtcacctgaggtcaggagtttgagaccggcctggccaacatggtgaaaccccgtctctactaaaaatataaaaattagccatgcatggtggcgcatgcctgtgatctcagctactcgggaggctgaggcaggaggatcacttgaacccaggaagtggaggttgcagtgagcagagatcgcaccattgcactccagcctgggcgacactaagactcttttctccaaaaaattaaaaaaataaattaaaaaaaagaaatccaggggaagtagaggaagggaagatgggaaacatggtttgtccagctataagagctaggttctataaaatagcttcaacgcagcactctgtccatttcacagctgagaaaactaaggctgctaagtggctacgtgaggactgacagcaggtcagtccctcagaaccaatgccccttcccacccaacaccctgctcctggaagattcaccacctgatatggtttcgatatttatccctgcccaaacctttgtggaattgtaatccccaacgggggagctggggcctggtgggaggtgtttggatcatgtgggcggacccctcgtggcttggtgccgtctttgtgacagtgagttctggggagatttggtcatttcaaagtgtgtggtgacaatgagttctagtgagatgtggcatctctccaccactcacactcccctcttgcttcgtgcctgctcctctttcaccttccgccatgagtaaaagtttcctgaggcctccccagaagcgggtgccaacactgtgcttcctgtacagccaggagaaccgtgagccaattaatctttctttataaattacccagcgtcaggtatttctttccagcaatgtgagaatggtctaatataccatccgagagtacattcttttgttcttttatttgttcatcatggactgatattttggtaaaaccataaaaataaagtgctacaaaaaataaaatttaaaaacaaaaatcacaaaaaccaataagctgggcacagtagctctcgcctgcaatcccaacattttctgaggctgaggtgggtgggtcattcaaactcaggagttccacgctgcagtgagtggtctattaaaagataaagtttcttctggctggtcctagctgcccccaaccctttagaggtccaagtatgagctcgatttggacacagaaatcccccacaactcttctctggtgtccacacaggggaactgcatggcctaaaagggccacacccagttgggggacaagcacaaacttccggcctggtgggacatggccggggtgctgctgccagagcaggaaaaagccccagcctgtcttagggtacctctgtatctccgggcacctctgcatctcggggcacagcaatggttgtacaaagtcccaactcccagagggagcgggtacaagggcacagccaggctgagcaccggctgtgacgaagcacaaggaggaggtgggtaaggggctgcaagacccgtgggcccctccagaaagggctggtcagcagggcacacccgctgggggcacgagggctccctgggggtcctgagacggcgcttctctgacgaggctctggagcaaagacggtctcctccatcccacatgcttcctgcgatgcaacccccgcgcccagcaccctaggaccatcacgccacctggaccacctcagcctggctcctccaagctgctgcgtgcccacccattgccggagctaacagggtccctaccgaccatctcagcactctcccacgctcctgttcctcgtctccctcagctcctacaacggccccaccgtccaccccgtgtaatgatccttgacctcttgctgtctcccaccttgtgcccacacctcggccaccacagtgtcttaccacaagagacctcaactggcctctgctgtgcactcccacttttttggctgccaaaggaatcttttcaaaaatgctttaccagggccgggcgcagtggctcatgcctgtaatcccaggactttgggaggccgaggcgggcggatcataaggtcaggagattgagaccatcctggctaacacggtgaaaccccgtctctactaaaaatacaaaaaattagctgggcgtggtggtgggcgcctgtagtcccagctacttgggaggctgaggcaggagaatggcgtgaaccccggaggcgaagcttgcagtgagctgagatcgcaccactgcagtccggcctgggcaacaaagagagactccatctcaagaaaaaaaaaaggcttaaccaggcttcccattccactgaggacatctggaccccaggctcctgcctgtcgctgccacgtgccctcagagcctgggatgtgtggcaggtgccgctctgtctgcaaggttcctcctaaccgcagggcaggctcctcctgccagtgggacctcaacctgaacatcactgcagggaagctttcctaacttccatctcacgttggcacaacgccatcaccccagtgtcgggtgtagtgagtcccactgtctggcacagtcttggcgactgaaacattttgtacacagaggacatgcacacacctgtgcacacacctgtgcacacacagggaaagaattggactatcagcaaatacacattaaatgatggaacaccactgtgatctctgatgactcagaacccttcacacagtgcccgtgagtcatgacaacggttctctgcagagcctgaggtctgcgaggtctacgggcctcttctctgagggactgctgtggcccccgtcctgtaccagctgccctgccactgggcttgcctccttaactcattggtcgcagccacccatgggggttgccgttctgagaatctgatcatgcaatcttatctggcctcaaatgtgcccgcgactcctgaccattttcaaaataaagtccgatctccttggcacagcgtatgaagacagaccgaggacacggcccagcctgcgtggctccagctgctccctgcaggcccagagcagcctttatctgccagttcctgtgcacgtgctactccaggtccccatgcccccatctccccactgggtgaggttccttcccaccaggtctcaggactcagcgggtcaccctgttttcaaaagcttcaggcagccaggacaggcagatggcacgtaccaccccctctatgtgagatgggtgctcccaggcctctgtgctctgcacagaagagcagcctgaaaaatccatacagcaagtgactcggtgcagcacccggtgagagcccagcatctccagcgctttatccatcacactcaggacccataagaagccccacacaccaagggcctgtaagtcagccgggctcggctcgcctttccttctgacctcatcatagaacggcctgctctgtttctgtacaaatcccatctcgggatgatccccaaagccccaaggctgagattaattggctttcaaaagcacggactcagcatctggacgcaatctgcctgtcggccagcaggcgtccccagcaagcacctggtttcaagaaggaccatgaagcttccgggttggggagcggcaggagaagccgccggggagggaaggcctcgctgtgcgttcaccctctttcaggagaaccagtggggctccctgaaccagccagctcccagcaggggctggaacagcatgggtgggcatcccatcactttgattttctcattttaaaaatactgagctgagctaacggtgatgttgtaggtttacctgttgtggtacaatgacacatcatggttttcttgcacagttcctggctcataactctcacacgtcacagtcttttgttgcaatgttgggcgtgtcaggcctcaggaaacagaatccttccaggtctccactctcacctgactttccattgtaggtcataagatcctccccagagctcccaccctctaccctgggggaaggaatgctgacttcaggaagcctccctaaacacccaagaggacagggtgtggagaggttcctggggagtggtgggtggggtgtgggggggtcctccaggaagcctcttcccccatatctccccttacgcatctcctcatctgtatcctctgtaataccctttataataaactgttacacgtatgtgtttccctgggttctgtgagtcaccccagcaaatcaatcgaacccaaagagggggctgtgggaaccccaacttgaagccagtggtcagtcagaagttccggaggccaggactcgcgactggtgtcagaagcgggcagtctttgaaccaccattgcaaaattataactcagacagtgaaagagatctgacctaaccaattccatcgtgcttctaacctccaagctctccttgttcattcctgggtgtaggccgaactaagtttaggaggaacttagtttatagtttgaaacaaagacagtaacagccctttcccgaaacaaaccccctttttgcctggggactagactgcctttgtaggactaacaaattagccaaaagattagaaattatggtttagggccaggtgcagtgactggccccggttgtcccagcactttgggaggctgaggctggatcacttgagcccaggagttcgagaccagccagggccacacggcaaaacgctgcctctaccaaaaatacaaaaattaactggggcgtcgcttgtagtctcagctaccaggcaggctgaggtgggaggatcgcttgagcttacgacgttgaggctgcagtgagctgtgattgcaccactgcactccagcctaggtgacagagtgagaccctgtctcaaaaataaaaaaaaaaaaacaaaaaagaaattatggtttaggagtcatgcagctacaggctacaagattctgaccttccccaaattgttcctggggtaacatcactattgtaaaacctaagatcaatcagtgcttgagatattttgcagaccctgcactccatggatcagctggcacccccggattgataaactggctcatccgatcttgtggcccccacccaggaactgactcggcgcaaaaggacaccttcgactccctacgctttcatctccaactcactggccccctacacactaagttatccttaaaaactctgatccccgaatgcttggggagactgatttgagtcataatagaactccgttctcccgcacagccggctctgtgtgacttactctttctctatcctaattcccgtcttggtgaatcggctctgcctgggcagcaggcggggtggacctgttgggtgtttatgtcttgggtgtttatgtcttggggactgagccctcaccctgtggtctgacctctctccaggcaggcggtgttggaactgaaccgaaggacacccgccgagtctgcggcagaactgactgctcatgtgctggtgaaaacctccctctcccaccacatttgatcacagaagtcttcctctgtgctgatgattcttgtggtatcagagtagaggaaaaacagtttgagttttccagaaatacctgtgaataaaatacacataaaataaaatctactaaaaatacacagagaaggggtttctccatgttggtcaggctggtctggaactcccaaactcaggtgatccacctgcctcggcctcccaaagggccgggcgcaggtgtgagccactgcgcccagcccaaatatatatatttttatgacctccatgtataaatatatttaatacccttaacttattattattattttagacagtcttgttttcttgcccaggctggaatgcagtggcgcgatcttggctcactgcaacctctacctcctgggttcaagctattttcctgcctcagcctcccaagtagctgggattacaggcgcccgccaccatgcccggctaatttttgtacttttagtagagatggggtttcaccatcttggccaggctggtcttgaactcctgacctcgtgattcacccgcctcggcctcccgaagtgctgggattacaggcgtgagccaccgtgcctggcctaatacccttaacttataagacacttcctgggactggaaggcaggtctggggtggctcattcactttgtactcaggacagaggactcaatctcagcatcctgagtagctgggactacaggcaggcaccaccatgcccagttaattttttttttaaatttcttgtagagatggggttccactatattgtccagcctggtcttgaactcctggcctcaaatgatcctctcacctttaaatgtactgaatttagctcttgtggcccctcttggattccagagagtgctgctaagccctctgggaggccaaattcagtaatctactcttttgttttgaaacagagtctcagtctgtcacccaggatggagtgcagtggcacaatcacagctcactgcagcctcgaatgcccatctaaaagctacagctcaagcgatcttcccacgtacttataggtgtgaaccactgcacccagcctctcatctactctttaaataggtccaggggacaaaaattatgtacctgtgaccccgtgttttttttcacttcctccactgactgccgaagagtagccacagccatttctaaaactgaaataagagagatgggcagtaggtctgaattctgtcagtggcacttgctggagaagaggggcaccactaccacgaaggaacatgaagggctgttttctttgaacgtgcatttgccaaaaaaaagtgagtaagtgagaaatagaagttgaagtcgaagtcttgtagttgagtttagactttgcggacttttagaaccacgtatacatgtttcatgtgccaaaaacaaagcacaacaaaaaacaaaaaaacttaaaatcagtaaggactcaaaatgaagtagaaacaggtgaacctaacttgattacaagtgcgtaacttgtaataaactcacaggtttttttggtgtttgttgtttgttgagatgggatctcactctgtcacccgagctgcagtgcagtggcatgattatagctcactgcagcctcaaactcctgagctcagatggtcctcctacctcagcctccagagtagctgggactcagacacacgccaccatggctggctaatttattttgtaattttttatagagatgggtgtctcactttgttggccaggctggtttccaactcctcacctcaagcgattttcccccctcagcttcccaaagtggtgggactacaggcgtgagccactgtacccagccagtttttaatatatacagagacacagatatactgaaatagatttgcatgtgtatagtgtatagaaacacgtttcctactctatccattaagaaagccaagaagaaatggcatcccagtagcaatatgtctatctggtactgggatcttggtttctaaacactaccttctaaactaaaaggaaccagggctccttggagaaatgactgattctgggatatgtcaaggcaagcataagataagcctgaattctgtgatgccagaaagaaagaaaatgctcccagaaggttgggacgtgctataaggacagagaggccaacttgaaggggctcctaacacctcaatctggataatgtgagcaacaaagtacgtgatagcgatgggttagaatccatggaataaaaagatgcactaacaccgagaccgcgcccctgcaagccagcctgggaagagatggttctttcttataggaaaatcccaactaataaatgtaggagtaatggaaacagaaaaatcatttaacaaatagcacattaacagttattttggggaaacactcatgggtgctaaaattagtgacagaagtatggttagaaacaagatcttgctgggcgttgtggctcaggcctgtaatcccagcactttcggaggccaaggcgggcggatcacttggggtcagcagttcgagaccagcctgaccaacatggtgaaaccccgtctctactaaaaatacaaaaaaaaaaaaaatagccgggcatggtggcaggcgctggtaatcccagctgctcaggaggctgaggcaggacaatcacttgaacccgggaggcagaggttgcagtgagccgagatcaagccactgcactccagcttgggcgagagagagagagactcagtctcaaaaaaataaaattaattaaaaaaaaaaaaaggccgggcacggtggctcacacctgtaatcctagcactttgggaggccaaggtggtggatcacctgaggtcagaagtttgagaccagcctggccaacatgacgaaacctcgtctctactaaaaatacacagattagctgggggtggtggtgggcggctgtaatcccagctacttgagaggctgaggcaggagaatcacttcaacccaggaggcagaggttgcagtgggccgagatcgcgccactgaactccagcctgggcggcaaagagagactccgtcttaaaaaaaaaaaaaaaagaaaaaaaaaaaagaaaaagagagaaagaaagaaacatcatcttttacatagtggcaagatatttccccacaaaatatttattatttacaaagggaaggaccctaactttatggacacacttggcagacaccacctcagcccccaggacgtgactagcaccaacagccaggggcatcctgtgtctcgtaagacgctgggaagggcacaatttccctgttgaggttttcttgccaaaaatcagtaatatgaaatcaattatgacaaaacatcagagaaatgcccccgaactggggggcattttataaaatagtggactcatcattggatcctggaccacggtaaagtcatccatgaggtagctgctaagcaagaataaatactggagaccagatcatgggatgataccaacatgaacgccagcgtctacatgttgctgaatgaactgtggttctctaagaggtcagcattctaggggctctgggcaaaaggcacacgggaaatctgtgctccttttgtatcctttttctaagttacagataattttttttttttttgagaccgagtttcgctcttgtctcccagactggagtgcaatggcgcgatcttggctctccgcaacctgcgcctctcggtgtggtaccctactttgttttaacctgactgactctctcttagctgagagggccggacagacaccattttggtttcttcgcttgcagccccttgtccccgtcccttaaggacataactggggcaagctgactccaagcacatccaggaatgcgcttactgataaaatactgataagaaactggagcaagctgtaccagcagctcctgggaacgcgctcggttgatggtacccaaagcccctgcgtttatcactttgtgataatttaagcccctgtacctggaactgtttattttcctgtaactgtttctgtaaccatttatcttttaactttttgcctattctgcttctgtaaaaaaatcgcttcagctagcctcccctcctctatttagaccaaggtatcaaaagaaatctagccccttcttcggggccgagggaatttgcagctctagcagtctgtcagtcgctggcaatacaggactcctgagtagtctcagagtgtggcgttctctctataactccctcagttacaacatcgggttcaagcgattctcctgcttcagcctccggagtagctgggattacaggcgtgcaccaccacgcccaataatttttgtatttttagtagagagggggtttcaccatgttggccaggctggtctcgaactccgggcctcaagcaatctgcccgcctctgcctcccaaagtgctggattacaggcgcgaaccaccgcctccggcctttttttttcctctctttttttttttttttttttaaactcacagacactgtaaggctgcctgggcgcggagccgtccttgccggcggcggaacccggggaattctcccggggctgcggggccctggtcggcagcgcccaccgccccaggtcacccacgggagaccgagggaacgctcccgctccacgcggccgcaacccccgccccgccccgccgcagcctccgcgaggggatccccggtccgggcctggccgagctctgagggtcgacctcgcgctccaggtccccaccaaagcgctgcgtccgacaggacggcagctgctggggttttctacaggaagagtggtcggagcggcgccccccacgcctcccacgcctcccacgccgcccgcccgcacctcaccctaacgcccgccagcagcgctggccaggtcccgccgcgttgccacagcgaccgggtcagtcggccgcgtccggctgcgctcggtgcagcgctcgggtcccgccgacaggaaacggggtccctggcgctaggttccggcccctcccgccccgccgggttccgcgctgcgcccgggtccgaggggcgccccggccgacccgaccaccgccgcagatcgaaggagggagcccggcctcctcaccggtcagcggggcgactccggacggggctccgggctatggggacggcgggttccgccgcgcgaggcgcccccaccttcgccgcccccggcccggccgagggtccccaggcgcccgcttcctgaggccgcccggctcgcggtcccgaagggttgacttgagcttttgccctgagatgaagggagcacggggcggccgaggctgcccgtgggggtctgttcgggccgggggcgccacgaagtcctgcctaagggtcggctgcggccaccggggcacgagttcccggcgctgcccacgggctcggagaccggcggggcccaggggccgtgcgcgcggtcgctcagaccctgattagggaactgggggaaggaggggggtcgggacccaccgaggcccgaagtcgcccccaccatcctgtgggaacaacatcctcaggcacagccattcccaaccattcacatcctcagaaaaaggcacgtgtccgtatccatctgcggatggatgaacagagcccggccccgggacagagcagcctggctcacccgaaccctcagcccgcaattctgcgtgggagtggagggggtgtttggtgtctgggaattcccctggtggggcaataagccaggggtctggtgtcatcctccacccacattgttaacactggatcactcctctccgtgccgtgcctgcagcccaggcaccctgcagcctgtcctccccgaaccatgcgtcctggtagagctgtctccctcgcccacagtcctcagtcccgcctcacacaccaaaccctcttctgcctcaggtcctttgcgccagttgcctctgcctagacttggttccctggatgccccctccccaccccatgtgtatgtccggctccctggacccaccccccacactgtgtgtctagccccctggacccaccccccactctgtgtctagtcccctggactcccctccccaccccctgtgtctagctccctggacccccaacctggcccatgtgtccaactcccaggacccccccaccctgtgtccagctccctggtttcccccaccaccccatgtgtttggctccctgtcctgctgccttctcagtgcttgtgcacccccagcctcatcagacttgtcactctattagaacaggatgtagggcctggactgttggctccctgctacccccacccacaggacagtgctggggttgacccgactttggctgcacatttgactggcccctggatcagctctaggactagatgtacccaaaaggatgcccacatccttgcctcagctcctgcctctgcccacccagagagctgccttgcccccatgtccacgatgcagccaccaggcctgggtaagcgtgggtgtccgagacgggctgggacacccagaagaggagccaggacttgcttggtctgtatcccggctctgcatgcctcagtgtccctgcctgtaaagtgggatctatgggaacccatgtgtgggccgggcacagtgctcacacctgtgaacccagcaccttgggaggccaaagggaggatcctttgagctcgggagacagggtctcgctctgttgcccaggctgtagttcagcggcgtgatctcagctcactgcagcctccgcctcccaggttcaagcgattctcctgcctcagcttcctgagtaactgggattacaggcacttgccaccatgcccagctaattttgtatttttagtagagatggggttttgccatgttggccaggctggtctcaaactcctgacctcaagtgatctgcctgcctcggcctcccaaagtgctgtgattacaggtgtgagtcatcatgcctggccaaaaaaaatttttttaaattaaccgggtgtgatggcacatgcctgtggtcccagctacctgaggccaaggtgggaagatcacttgaacacagcacttcgaggccacagtgaactatgatcgcgccactgcactccagcctgggtgacagagcaagaccctgtctccaaaaaaaaccctctaaacctatgtgttatggatagggcctctaagaaggtaattaaagttacgtgagtcctaagggtgggaccctgaactgttgtccttaaaagaagaggaagagacaccaggagtgagcacacagaggagaggccacatgaggacgcagggagagggtgccgtctgcaagccatggagaggcctcaggaggaacccaccctgccggcagcctgatccctgacatccagactccggaagtgagaaaataaatgtcgtttaagccgcccaggctgtggtgttgagttatgcggccctagcaggtcatttgtcacgtcatgggtatctggacctggaatcgtgtgctggcccaagtcagcagcatggcacccatggtcaccccttcagctgagccacatgcccgggtgccccagggacagagcagggtgtgccacgggcactgcctggttcctgaagctgtggggcaggccggtctggccctcacagcctgtgctctgattcgagggccgttccgttgggttgagctccacggtcccagagcgcccgccgtcagctcaggcccgaggctacacctactgaatccccccagcactgcagcacccctccccttccttccctgccccccacactgcagcacccctccccctccttccctgccccccccacactgcagaacccctccccctccttccctgcccagctccccagctgggctccacctgggcaccctcagtgcgggtggccgggagttggctgagggagaccacattcccttcactcctggcctccagcacccagcaggactcacaggtggaaggcagacagggtgtgagccagggcctgggccgccaaaacaaagaaccccaaactggtcctttcttctttcccagttcaggaaagctgaggatgtcggccgggccatggcccctccaaaagccctatgggagaatccttcccaccttggcctcaggtagctgggaccacaggcacctaacccttccagcctcggcacccttggctgcagccacatcgccccctcccgcccctatatccaccatcatgcggcttctcctgtgtgtctgtctccatgtgctgcccttcttaggacgccatcacgttggagcaggaccacccagccaattacgtcggcgatgaccctattcccaagccgcattctaatggaccagcggctacgactggatcctatttctttggggaccaccattcagccctggacctgtgtggggctgacagcccccagtgctggctcccccaggccgtcctgcaaccaccctcatcatgccacgacagtggaggccgagggcccttcctggtgccccggtgagtgacacggccaggacctgaccctcccatgcctctgtggcagagcaaggtgggtggggaactggctgtcctgctcccagctgcgttcctggcacctatgccccacccacccagacacacatctgggtgtcaggcagccgcatgtcactgagtggggtaaacaagggagggtgagaggaaggtcagaaggccatggctgagggcgtaagtgtgggctgaggctcttgcttcccagaacacagactgaccttggtggcagacctcaccatgggagcccccaaaagctgcttgcttgaggcctccaggcctcttgcagggccctaaaagcacagggatccaggacaagaggtgcgggggcccccgcctgggcaccagcctgcatgggccagagcaagccacttcctctcaggtttggggaatgcccacgtcagacttgcagaggcaacttctccatctgtctggctcacaggccctgtggcaggagaggagccaagaaatgaaagggcccggtgggtgtgggcgggccctgctccgatctggatctggccagtgcctgtggcacgccctgctctgtccctggggcacccgggcgtgtggctcagctgaaagggtgaccatgggcaccatttgcctggctcccaggtcctgaggccagagaggagccaagaaatgaaagggcctggtgggtgtgagtgggcctcagtgtctggctgctccaggaggaggggggtgggcactgactcctgcctgagggctggaggcagggaggctcctctggacaggaagaccctccaggaacagaccagcaagactggcactgtccagatgggaccaggagccggacagcggcgtcagacatgccccacagcggccgtgaccacagccacttcctggaggtcaagacctggaggcagggccagtgctgccagggatcctggtgtggacacgggcaggaccaggggatgctccctcgaggctggtgtggaacaggccgtgctgcccagtgggtgggcacccaagggggctccaagccaggctgtcctcccaaggccggcttcgtccagaaggagaggagccaaggtgccccggcatccaccttcctcggctgccttgtccactgcagggacagcagcctgtgagcaggaggtgctttgagggagctggggggaccctgggggacacacggcatttccacactgtaaccacgtcacgtagagaccacaaagtcctcctgtcttggggtaaaagtgaggaaactgaggctggggaagctaaggggctcacgtggcctctggaagggacggggctggaccccggccgccgacagtgtgaaaacagcggttcctgagccagtgttgcggcaaggggcaagggacaggcactgtcagaagccccatgcccctccccaaccccccaggaagttccactgagttctcagtgctgagtcactggctgcggggcctgcggtcctggccggacaggaaggttgggcaaggccttgccctccccctcaggcgagaggcacagatcctgccacacagcccggccccactccccaggcccccggccccataggcctctagccacagcctggctgctgtcctcatgtccttggctctggcctggtgaaggccaagggcacttcagaacctccctgtgcctccatgtgccaggttggggctgggcacgaggccacagcaggggctggcaggtggtgacctctgctcctcgacctgggatgctccaggttgagacgtagggtagctgcagtcccagcaatgacaagctctgggtaaccctggtgagtggacggccaaggcgagcccagcctcagtcactggggggtggacggccaaggggagcccagcctcggtcactgggggggtggacggccaaggggagcccagcctcggtcactgcggggtggacggccaaggggagcccagcctcggtcactgggggggtggacggccaaggggagcccagcctcggtcactgggggggtggacggccaaggggagcccagcctcggtcactgcggggtggacggccaaggggagcccagcctcggtcactgcggggtggacggccaaggcgagcccaggaggtcactggaggaggagaaatgcaggaagaaggcagctgtcaatagcgcaggggtgcacagagccctgaaggagccatgtgtaaggtgccgagggtgtgtgcaggtggagcttggtcagggaggccgcaccaggaccaccaaagcaggtgatacctgaatgatgttctaggccaaggaagagaggacagaggcccggccagggctagagcataaaccaggctggtgctgaccacggcagaagggcagaaggtaccctccggctgtgcgtggagaacgggcagcagggacgagggcctggggccaggctggtggcactggctgttcccgaagcccgtcactcacctgcatctgttccatccaggcgctggggtgggcaggacaccaggatgccaatggctcactgagccgccgggggcaccgctagggcttggggaccacgggacttgccactggacatgggggttgaggataagggagagaaaggctgaggcagccccgtgtgagcccagcaggactgagggtctcggagggtctgggctctaggacgtttcggggttaccgtgagaggaagctcctaaggaccgtgagagtggatggggccaccccaggcaggtgtgggcagggaggagaggagcagggatggggcccatacattgggctcaggagatgcagggaagcccccaagctgcagaagaggaggacacccgggaccaggcagggcctggaggccggggcagcgatggagccctgctgggcctgcaggtctgaggcacttgggggttggcctggaggcctagggagggggtgtggggcagcagcacactttgctggtgccacctgggaaggtgcccacccatctccaaggggcgggggaggagctagtctgtgcggtgagggtgacactgtcccagtcaccctcccctagacagcagggaaggtccggtcacccccaggcacttgcaggccgtgggggctccccaggagccagtggccgcccgtagggtctcgcaggccagaggcctcgctccctgggcctgctgtgtctctggaggccccagctggcagggggaccaatggggcccttccccaccgcctcccaggtgccggtggccgcccctgagcagggggttctggggcccctgcctggactgctcccccactgcttggccccgcctctcagtctcggacttggggaggagcagccaggccaaagggtgcaaagagggggctggggggctgcactgaaaggcggggggtctgcgctgagaagggtggctacaggcgagcatgggctgcgctgttcccacccagccttgagttccagtcttgactcctctccttccacactccagtcctgcctccatggcagacccagggccgacgtgggctccaaggagggcagaggaaaccctgaccccccagcccccagctcaagaggaggcaggggtgggacacagggcaggtggagcagagaaaggcgaaaaaacgcactccaggatgctggacgctcagggccgggggggccctttcacagcaggttgggggggctctcagggccacactttgcccagcctccaaagggctgagccaagaggagagggcagtgtccccacccatccagccacctgccaccccgatcctgggacagagttgtctctgttggcccagtgtggcctggacaccctaggctgggctccacggccaccccaaaaccttcttgccaaggaaggctgttcctcccccagtgcccaggagagctgcctcctgctccatgtctaccactgaggcctccagctgatgacctcctggcctgctgaggcttgaatgttggggccaaggggctggggtagggctccactccaccccaggagtgggaaggggagacccagggcaacctctggcctcacaggcagcccctgcctggcacacccactccagcttaaacatggaagcaggctgatcacactgatttttgtccttaggaaagtaatagattccggccaggcatggtggcttatgcctgcaatcccagcactttgggaggtggaggtgggagaatcacctgagctcaggagttcaagaccagcctggccaatacagtgagatcctgtctctatctaaaaaaaattttttttaagtaaataaaaaaagaaagtaaagatctcttccacaaaagtgctggggcaactggatatccacatgcaaagaataatgctggatccctatctcacaccgtttataagtatcaatgcaaaatagatcaacaaacaaaacataagagctaatatcacaaaactctcagaagaaagcataattaattaattaatttaatttatttatttagttttagacagagtctcactctgtcacccacccaggctggcatgcagtggcgcaatcccagctcacggcaccctttgcctcctgggttcaagcaattctcgtgcctcagcttcccgagtagctgggattacaagcatgcaccaccacaccgggctaatttttgtatttttagtagagacaggtttctactggccaggctggtctcaaactcctggcctcaagtgatctgcccacctcaacctcccaaagtgctgggattacaggtgtgagccactgtgcctggcccagatttttgatatgataccaaaaacacaagcaacataagaaacaaagatacaattttgtgcatcaaaggagagtgaaggcagcccacagaatgggggaaaatacagaccatatatctgttaagagtttaatacccagaacatgtaaaactcaacaaagggccgggcacggcagctcacacctgtaatcccagcattttgggaggctgaggcaggcgagtcacttcagctcaggagttcaaagaccagcctgggcaacatggtgaaaccctgtctgtacaaaaacatacaaaaacattagctgggtgtggtggtggtgcttgcctatcgtcccagctacttgggaggctgaggcggggaagactcgtgtgaacccgggaggtgaaggctgcagtgagctgagaacgcaccactgcactccagcctgggcaacagagtaagaccctgttccaaacataaaagagaatgaaactaaacaacaacaacaaaaaagacaacccaataccaaagaagatacagaatggccaacaggcacatgaaaagatactcaacatcattagtcattagagaaacgcaaatccaatccatcatgagatactacttcacacccacgagcacggctttaatgaaaaacaaacagggctggtgtggcagcacgggcctggagtctcagccaggcaggaggcggaggcaggaggatcacttgagcccaggagttcctgcctgggcaacataagaagaccctggtctctgaaaaacaaacacctcccagaaaacctccacataaaataacaggcgctggtgcggatgtggagaaactggaacccttgaacaccctgctgagaatggagatggccaaagcctccgtggaaagcagtgtggtggctcttcatggacaggagcgtcgccctgggacccccaactccgctcccacgttcgtggacaggagcctcgccctgggacccccaactccgctcccacgttcgtggagaggagcgtcgccctgggacccccaactccgctcccacgttcgtggagaggagcgtcgccctgggacccccaactccgctcccacgttcgtggagacgagcgtcgccctgggacccccaactccgctcccacgttcgtggagaggagcgtcgccctgggacccccaactccgctcccacgttcgtggagacgagtgtcgccctgggacccagcaactccgctcctacattcacaccaaagagaaacgaagacatctgttcacacaaatactggcccaggaatgtccgtggcaccactgttcacaacagccaaaaggtggagatgacccaaatgtccatcaacagatgagtgaagaaacgaaacgtggtccatccacatgaggaaacatcattcagccgtaaaaaggtatgaagaggccgggtgtggtggctcatgcctgtcatcccagcactttgggaggtcgaggcaggcgcctcacctgaggtcaggagttcgagaccagcgtgaccaacatggtgaaaccctgtcgctactaaaaatacaaaaattagctgggcgtgatggtgcacgcctgtaatccagctactcgggaggctgaggcaggagaatcactcgaaccagggaggcggaggttgcaatgagccgagatcaagctaccgcactccagcctgggggacaagagcgagactccgtctcaaaaaaaaaaaaaaaaaaaggaatgaagcactgatagaccctctcccatggacgaacatggaaggaagacatgatgctcagtaaacacgctggtcacaaaggccacaccctgcagggctccattcacatgaaacatccaggacaggccagtccacagacacagacagcagatgggtggataccggggaagggggggtgctgtgggaaggaggatggggagcaattacttaatgagtgcacggtgtttttaaggggtgatgaaagagttttgaaactagacagctggtggtggacaacaacgtgagcacgtccagtgctgctgagctgccctctaccgtaaccgtgtgctacaagagctctaccttaattaattaattattattattattatttctgagacggagtttcgctctttgttacccaggctggagtatagtgtcgcgatctcggctcactgcaacctccgcctcccaggttcaagcaattttcctgcctcagtctcccaagtagttgggattaccggcatgtgccatgacgcctggctaatttttgtatttttggtagagattggccaggctggtcaccctattggccaggctggtcttgaattcctgacctcaggtgatctgcccacactggcctctcaaagtgctgggattataggcgtgagccactgcgcctggactatttatttatttacttatttattttttctttttgagacagagtcttggtctgtcacccaggctggagtgcagtggtatgatctaggctcactgcagcctccacctcctgggttcaagtgattctcctgccctcctgcctcagcctcccgagtagttgggattatgggtgcatgccaccacgtgtggctaattgtttgtattttttggtagaaattcggtttgctgcacccactttacagagcaagagactgaggtccagagaggtccccacacttctttctttccccacttgaccacattcttggaatgaccgctcaggatccaatgagcattagttctgaatgttccagcagcattgaccctgtctcagttctgtctcccagtgacagagcgagaggtcactgaggacatcaagaagacctggccagcacacgacagctgctctcatcagaccatgcacacctacaccccaacacctgtgcacagacacccctacacctgtgcagacgcacccctacacccgtgcacagagacacctgtgcagacacaaccctacacccgtgcagacacacccccacacccgtgcacagacacctgtgcagacacacccctacacccgtgcagacacacccctacacccgtgcacagacacctgtgcagacacacccctacacccgtgcagacacacccctacacccgtgcacagacacctgtgcagacacacccctacacccgtgcagacacacccctacacctgtgcagtcacctgtgcagacacacccctacacccgtgcagacacacccctacacctgtgcagtcacctgtgcagacacacccctacacctgtgcagtcacctgtgcagacacacccctacacccgtgcagtcacctgtgcagacacacccctacacccgtgcagacacacccctacaccttgcagtcacctgtgcagacacacccctacacccgtgcagacacacccctacacctgtgcagtcacctgtgcagacacacccctacacccgtgcagtcacctgtgcagacacacccctacacccatgcagacacacccctacaccttgcagtcacctgtgcagacacacccctacacccgtgcagacacacccctacacctgtgcagtcacctgtgcagacacacccctacacccgtgcagtcacctgtgcagacacacccctacacccgtgcacagacacctgtgcagacacaaccctacacccgtgcagacacatcccaacatccatgcacagacgcaccccaacacctgtgcacagacacaccctcacgcccgtgtacacccccaaccccacataaccggccctctcataaccctacaccatgcatcacacccaaaccccatgaccaacacccaccacaggcagcagtgtggtgggtcaggccccactgggccacggtgcggcttctcctgcccttttcacctctgccccctacctgggctgccactccctgggaaggaccagcagccaggttaatatgtatttttctgactttgggaggccaggcaggtgaatcacaaggtcaggagttcaagactagcctggccaaaatggtgaaaccctgtctctactaaaaatacaaaacattagctgggcgtagtggcaggtgccggtaaccccagctactcaggaggctgaggcaggaaaatcgcttgaacttgggaggcagaggttgtggtgacccaagaatgcaccactacactccagcccggtgacagagtgagactctgtcaaaaaaaaataataataatatgtatttttctgtgagcctggacaggttctctggggcgagtgaagggagggcgcagatttgggccatggtcctggtcctgggtctaggctctgtgtggtggagggcaccagcctcccctggcaccgtcctggctgcatcccccatccagcctgggcacgtcccgccacacgccccgcgtgggtctggagtctggggacggtgtggccacaggtgtggaatgacaggctgtgacagttgtgtcaccagatcctctgggcagggagctgtaaggcaggcagggtcaggagctgggcagcccaggaccccagggaggcggggctgtggctcggccggaatgtccttccccgtgactcggctttcttcccctgacccggccagtcctggccccagtcctgtccatggggcggcaactggtgctgggtggtacggccaagactgggtcaggacggggtggccctgctgggatctggaaaatggtgtgcggggttcccaaggacgcaggatgtgggctgtgtggctcccccgaccctggaaggttccctgggacctgagatctggccctgataggtccgggggcctgttctgccaccctccctggggcagcggctgtggtgacccttgg

SEQ ID NO: 3 - DNA, 172827 bp, Homo sapiens
accttcatacttcttccacacgcataccaaagaaaataagaatctcaaggttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggtcggtctttctccaccagactccacctggaactttcttccttttcgtcctgtgctggcctaacccctgctcggcctcggccctcagctgccggctctaacaaagcctctgtctttcccagacccctgtgaccaggtcaggctctgctccctgcgttcctctctccttgcttccctcctcctcccctccccagaatcgcttgaacctgggaggcagacgttgcagtgagctgagatcgcaccattgcactccagcctgggtgacaagagcgagactccatctcaaaacaaaaaacaaaaaacacaactcttgctggctccttgattttagcccagtgagattcacttctaatttctttttttctttgagacagtctgttctgtcacccaggctggagtgcagtggcgtaatcatggctcactgcagcctcaaccttcctggactcaagtgaaccttccacctcagcctcccaggtagccgggactacaggggtgcaccagcatgcctggctaatttttgcattttttgtagagatggggtttcactatgttgcccaggctggtctgaaactcctgtgccccagcagtcctcctgccttggtctcccaaagttctgagattacaggcatgagccactgcgcctgggcttccatttctgatttccaaaactctaggataataaatttacattgttttaagccaccaaattgtagtaatctgttacagcagcaataagaaatgaatacagccatgcttgataattcctttatcaaaagctacctattggtgttaggaagtattgttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgcc

SEQ ID NO: 4 - DNA, 176462 bp, Homo sapiens
accttcatacttcttccacacgcataccaaagaaaataagaatctcaaggttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggtcggtctttctccaccagactccacctggaactttcttccttttcgtcctgtgctggcctaacccctgctcggcctcggccctcagctgccggctctaacaaagcctctgtctttcccagacccctgtgaccaggtcaggctctgctccctgcgttcctctctccttgcttccctcctcctcccctccccagaatcgcttgaacctgggaggcagacgttgcagtgagctgagatcgcaccattgcactccagcctgggtgacaagagcgagactccatctcaaaacaaaaaacaaaaaacacaactcttgctggctccttgattttagcccagtgagattcacttctaatttctttttttctttgagacagtctgttctgtcacccaggctggagtgcagtggcgtaatcatggctcactgcagcctcaaccttcctggactcaagtgaaccttccacctcagcctcccaggtagccgggactacaggggtgcaccagcatgcctggctaatttttgcattttttgtagagatggggtttcactatgttgcccaggctggtctgaaactcctgtgccccagcagtcctcctgccttggtctcccaaagttctgagattacaggcatgagccactgcgcctgggcttccatttctgatttccaaaactctaggataataaatttacattgttttaagccaccaaattgtagtaatctgttacagcagcaataagaaatgaatacagccatgcttgataattcctttatcaaaagctacctattggtgttaggaagtattgttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaat

SEQ ID NO: 5 - DNA, 19421 bp, Homo sapiens
caccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaat

SEQ ID NO: 6 - DNA, 21014 bp, Homo sapiens
actgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaat

SEQ ID NO: 7 - DNA, 32030 bp, Homo sapiens
caccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccatatgatcatttcaacgatgcagaaaaaaagtttcataaagccaccatcattactgataaaacctgtcaacaaggaagatacatagatgaaaaataagcacaggaagagatacttaatgtcattaaacactaagaaaatgcaaactaaaaccacagcaagataccattaccatctattaaagtggctaaaattacaaagactgacaatagcaagtgttggtgaggatgtggagggaaggaattctcatacactgctcatgggactgtcaaataatatggtcactttggaaaacagttcagtagttcctttaaaagttcaacagtcactaaccatatgatccagcatggccttctaattatttttccaagagaaaaggaaatctgtgaatgttcatagcagctttatttgtaatagccaaaatttgaaaacaacacaaagctcaccaattgataacaaattatgatatatccatgcaaataaagtgctactcggaaataaaaaagaatattgttatacacacaaaatcattaaatctcacagaaattattacaagtagtgcttgctttggcagcacgtttagtaaaattggaatgatacagagattagcgtggcccctgcacaaggaggacatgcaaattcatgaagtgttccatattttaaatttaattttatgataaagaaaaacattggagggctgggcgtggtggctcacgcctgtaatcccagcactttgggaggccgaggtgggtggatcacaaggtcaggagactgagaccatcctggctaacatgatgaaaccccgtctctactaaaaatacaaaaaattagctgggcatggtggtggacacctgtagtcccagctactcgggaggctgaggcaggagaatggcgtgaacccagggggcggagcttgcagtgagccgagatggcgccactgcactccaacctgggcaacagagcgagactccgtctcaaaaaaaaaaaaaaaagaaaagaaaagaaaagaaaaacatgggaaggatctggcaagatgtctgaataggaacgctctggcctgccagcgagaccaatgcagaaggcaggggatttctgcatttccaactgaggtaccctgttcatctcattgggactggttaggcagtgggtgcagcccatggaaggcaggcagaagcagggcggggtgttgcctcaacccaggaagtgcaaggagtggggggcctccctccaccagccaagggaagctgtgagggactgtgctatctggcccagacactacgcgtttcccacggtttttgcaatccacagaacaggagagtccctcatgtgactacaccaccagggccctgggtttcaagcacaaaactgggtggctgtttgggcagacactgagccagctgcaggagtgtttttttataccctagtggcgcctggaaccacagcaagacagaactgttcaccccctggaaagggggctgaagctagggagccaagtgggctcactcagcgggtcccactcccacggagcccagcaagctaagagccactggcttgaaattcctgctgccagcacagtagtctggagctgacctggagcttggttgggggaggggcatctgtcattactggggcttgaataggtggttttcccctgacagtgctaaggaggcctggaagttcggactgggcggaactcaacacagcacggcaaagaggctgtggccagactgcctctctagattcctcctcactgggcagggcatctctgaaagaaaggcagcagtcccagtcaggggcttatagataaaagtcccaactcccttggacagagcacctgggggaaggggcggctgtgggtgcagcttcagtggacttaaacgttcctgcctgctggctctgcagagagcagcagatgctgacaaggagggctctcccagcacagcactcgagctctgctaagggacagactgcctcctcaagtgggtccctgacccctgtgtcacctgacggggagagacctcccaacaggggttgacagacacctcatacaggagagctctggttggcatcaggctggtgcccctctaagatgaagcttccagaggaaggagcaggcagcaatctttgctgttctgcagcctccactggttatacccaggcaaatagggtctggagtggacctccagcaaactgcagcagacctgcagaaaaggggtctgactgttagaagaaaaactaacaaacagaaagcagtaacatcaacatcaacaaaaggatccccacacaaaaaccccaaccacaggtcatcagcctcaaagatcaaaggtagataaatccacaaagatgaggaaaaaccagcttaaaaatgctggaaatttcaaaaatcagaatgcctcttccccaaatgatcataactcctgtctagtaagggcacaaaactggacagaaaatgagtttgaaagaattgccaaattgacagaagtaggcttcagcatatgggtaataacaaactcctctgaggtaagggagcatgttctagccaaatgcaaggaagctaagaacgttgacaaggttataggaatggctaactaggataaccagtttagaggagaacataaatgacctcatggagctgaaaaagacagcacgagaacttcgtgaagcatacacaagtatcaatagccgaatcgatcaagaggaagaaaggatgtgagagactgaagaacaacttactgaaatagggcatgaagacaagattagagaaaaagaatgaaaaggaacaaacaaagcctccaagaaatatgggagtatgtgaaaagaccaaacctatgattgatcagggtccctgaaagtgatggggagaatggaaccaagttggaaaacacacttcagaatattacccaggagaacttccccaacctagcaagacaggccaacattcaaattcaggaaatacagagaatgccacaaagatactcctcgagaagagcaaccccaagacacataatcgtcagattcaccaaggttgaaatgaaggaaaaaatgttaaggtcagccagagagaagggtcaggttacctacaaagggaagcccatcagatgaacagtggatctctctgcagaaaccctagaagccagaagagagtgagggccaatattcaacattcttaaaaaaattttcaacccagaattccatatccagccaaactaagcttcataaatgagggagaaatatagtcctttacagacaagcaaatgctgagggattttgtcaccaccaatcctgccctacaagagctcctgaaggaagcactaaatatggaaaggaacaactggtaccagccaccacaaaaacacaccagaatataaagaccaatgacactatgaaaaaactgcataaaggaatgtgcaaaataaccagcaagcgtcatgatgaccggatcaaatttacacataacaatattaaccttaaatgtaaatgggctaactgccccaattaaaagacacagactggcaaattggataaagagtcaagacccatcggtgtgctgcattcaggagacccatctcatatgcaaagacacacatcggctcaaaataaagggatggaggaatatttaccaagcaaatggaaagcaaaaagagcaggggctgcaatcctagtctctgataaaacagactttaaagcaacaaagacaaaggagggcattaaataatggtaaagggatcaatgcaataagaagagctaactatcctaaatatatatgcacctaatacaggagcactcagattcataaaagaagttcttagagacatacaaagagacttaggctcccacgcaataatagtgggagagtttaacaccccactgtcaatattagatcaacgagacagaaaattaataaggatattcaggacttgaactcagctctggaccaaacagacctaacagacatctacagaactctccaccccaaatcagcagaatatacattcttctaagaaccacatagcacttattctaaaatcggtcacataattggaagtaaaacactcctcagcaaatgcaaaagaacggaaatcataacagtctctcagaccacagtgcagtcaaattagaacccaggattaagaaactcactcaaaaccacacaattacatggaaactgaacaagctgctcctgaatgactactggatgaatgacaaaattaaggcagaaataaaaaagttatttgaaaccaatgagaacaaagacgcaacataccaaaatctctgggacacagctaaagcagtattaagagaaaaatttatagcactaaatgcctacagcagaaagtggaaaagatgtaaaattgacactctaacatcacaattaaaagaactagagaagcaagagcaaacaaattgaaaagctagcagaagacaagaaataattaatatcagagcagaagtgaaggagatagagacacaaaaaacccttcaaaaaaatcaatgaatccaggagttggttttgtgaaaagattaacaaaatagaccactagctagactaatatagaggaaaagagagaagaatcaaatagacacaataaaaaatgataaaggggatatcaccactgatcccacagaaatacaaactaccatccgagaatactataaacacctctatgcaaataaactagaaaatctagaagaaatggataaatttctggacacatacaccctcccaacactaaaccaggaagaaatcgaatccctcaatagaccagtaacaagttctgaaattcaggcagtaattaatagcctactaacaacaacaaaaagcccaggaccagacagattcacagaccaattctaccagaggtacaaagaggagctggtactattccttctgaaactattccaaacaatagaaaaagagggactcctccctaactcattttatgaggccagcatcatcctgattccaaaacctggcaaagacacaataaaaaaggaaaatttcaggtcaatatgcctaatgaacatctatgcgaaaatcctcaacaaaaatgggcaaatagaatccagcagcacatcaaaaagcttatccaccatgatcaggtgggcttcatctctggaatgaaagcctggttcaacatatgcaaatcaataaacataatcaatacataaagagaacaaatgacaaaaactacatgattagctcaacagatgcagaaaaggccttcaataaaattcaacgccccttcatgctaaaaattcttaataaactaggtatcgatggaaggtatcccaaaataataacagctatttatgacaaacccacagccagaatcatactgaatgggcaaaaactggaagcattccctttgaaaactggcacaagacaaggatgccctctctcaccactcctattcaacacagtaatggaagttctggcctgggcaatcaggcaagagaaagaaataaagggtattcagataggaaggcaggaaatcaaattgtctctgtttgcagatgacattattgtatatttagaaaaccccatcgtctcagcccaaaatctccttaagctgataagcaacttcagcgaaatctcaggatacaaaatcaatatgcaaaaatcaccagcattccaaatcaataaatgtaatccatcacataaacagaacctataacaaatccacatgattatctgaatagatgcagaaaaggcctttgacaaaattcaacacccttcatgctaaaaactctcaataaacttggtatcaatggaatgtatctcaaaacagtaacagctatttatgacaaacccacagccaatatcatactgaatgggcaaaaactgaaagcattccctttgaaaaccagcacaagacaaggatgccctctcttaccactcctattcaacatagtattggaagttctggtcagggcaatcaggcaagagaaagaaataaaaggtattcaaataggaaaagaggaagtcaaatagtctctatttgcagatgacatgactgtatatttagaaaaccccatcatctcagccccaaatctccttaagctgataagcaagttcagcaaactttcaggatacagaatcaatgtgcaaaaatcacaagcattcctgtacacaaataacagacaaacagagagccaaatcatgagtgaactcccattcacaattgctacaaagagaataaaatacctaggaatccaacttacaagggatgtgaaggacctcttcaaggacaactacaaaccattgctcaaggaaataagagaggacacaaatggaaaagcaatccatgctcatggataggaacaatattgtgaaaatggccatactgctcaaagtaatttatagattcaatgctatccccatcaagctaccactgactttctttacagaattggaaagaactactttaactccatatggaaccaaaaaagagcccgcatagccaagacaatcctgggcaagaagaacaaagctggaggcatcatgctacctgacttcaaacaatactacaaggctagctacagtaacaaaaacagcatggtaccggtaccaaaacagatacttaggccaatggaacagaacagagaggcctcagaaataacatcacacatctacaaccaactgatctttgacaaacctgacacaaacaagcaatggggaaaatattccctgtttaataaatggtgctgggaaaactggctagccatatgcagaagcctgaaactggaccccttcctcacaccttatacaaaaattaactcaagatggatcaaagacttaaacgtaagacctaggtccataaaaatcctagaagaaaacctgggcaataccattcaggatgtaggcatgggcaaagactttatctctaaagcaccaaaagcaatggcaacaaaaaccgaaattagaatttctctgatgactagtgatgatgagcattttttcgtgtgtccgttggctgcataaatgtcttcttttgagaagtgtctgttcatatcctttgcccactttttgatggggttgtttgttttcttcttgtaaatttgtttaagttctttgtagattctggatatcagccctttgtcagatggatagattgcaaaaattttttcccattctgtaggttgcctgatcactctgatggtagtttctcttgctgtgcagaagctctttagtttaattagatcccatatgtcaattttggcttttgttgcccttgcttttggtgttttagtcatcaagtctttgcccatgcctatgtcctgaatgatattgcctaggttttcttctagggattttatggttttaggtctaaaatttaagtctttaatccatcatgaactaatttttgtataaggtgtaaggaagggatccagtttcaactttctacatatggctagccagttttcccaacaccatttattaaatagggaatccttttcccactgcttgtttgtgtcaggtctgtcaaagatcagatggttgtagatgtgaggtgttatttctgaggcctctgttccattccattggtctatatatctgttttggtaccagtaccatactgtagccttgtagtatagtttgaagtcaggtagagtgatgcctccagctttgttcattttgcttaggattgtcttggctatgcaggctctttctttggttccatatgaactttaaagtagttttttccaattctgtgaagaaagtcattggataccatctcaggctggttagaatggtgatcattaaaaatcaggcaacaacagatgctaaagaggatgtggagaaataggaatgcttttacactgttggtgggagtgtaaatttgttcaaccattgtggaacacagtgtggtgattcctcaaggatctagaactagaaataccatttgactcagcgatcccattactgggtatatacccaaagaattataaatcatgctagtataaagacacatgcacatgtatgtttattgtggcactattcacaatagcaaagacttggaacccacccaaatgtccatcaatgacaggctggattaagaaaatgtggcacatatacaccatggaatactatgcagccataaaaaaggatgagttcatgtcctttgcagggacatggatgaagctggaaaccaccattctcagcaaactatcacaaggatggaaaatcaaacaccacatattctcactcataggtgggaactgaacaatgagaacacttggacacagggtggggaacatcacacactggggcctgtcaggggttagggagctgggggagggatagcattaggagaaatacctaatgtaaatgatgagttgttgggtgcagcaaaccaccatggcacatgtatacatatgtaacaaacctgcacattgtgcacatgtaccgtagaacttaaaatataatttaaaaaacaaaaaaacaaaattgacaaatgggatctaattaaactaaagagcttctgcatagcaaaagaaactatcatcagagttaacaggcaacctacagaatgggagaaaaattttgcaatctatccatctgacaaagggcaaatatccagaatctacaaagaacttaaacaaatttacaagaaaaaacaaacaaccccatcaaaaagtgggcaaagtatatgaacagaaacttctgaaaagaagactttaatgcagccaacagacatatgaaaaaattctcatcatcgctggtcatttagagaaatgcaaatcaaaaacaacaatgagatactatctcaggccagttagaatggcaatcattaaaaagtcaggaaacaacagacgctggataggatgtggagaaatagaaacatttttacattgttggtgggagtataaattagttcaaccattgtggaagacagtgtggtgattcctcaaggatctagagctagaaataccatttgacccagcaatcccattactgggtatatacccaaagaattataaatcattctactataaagacacatgcacatgtatgtttattgcagcacaattcacaatagcaaagacatggaaccaacccaaatatccatcaataatagactggataaagaaaatgtgccacgtatacaccatggaatactatgcagccataaaaaaaggatgagttcatgtcctttgcagggaccggatgaagctggaaaccaccattctcagcacactatcagaagaacagaaaaccaaacactgcattttctcactcgtaagtgggagttgaacaatgagaacacaaggacatagggaggggagcatcacataccagggcctgtcaggaggtggggggctaggggagggatgacattaggagtgatacttaatgaaggtgatgggttgataggtgcagcaaaccaccatggcatgtgtatacctatgtaacaaaactgcgcattctgcccatgtagcccagaacttaaagtataataataaaaaaaaatcaccagcattcctatacacaaaaaataaacaagcagaaaaccaaatcatgagtgaactctcattcacaattgctacaaagaaaataaaatacctaggaatacaacttacaagggacatgaaggaactcttcaaggagaactacaaaccactgctcaaggaaataagaaaggacaaaaacaaatggaaaaaacattccatgctcatggataggaagaatcaatatcatgaaatggccatactgcccaaagttatttatagattcaatgctactcccatcaagctaccattaactttcctcatagaactagaaaaaactactttaaatttcatatggaacctaaaaagagcccgtatggccaaggcaatcctaagcaaaaagaacaaagttggaagcatcatgctacccgactacaaggctacagtaacaaaaacagcatggtactggtaccaaaacagatatatagaccaatggaacagaacagatgccccagaaaaacaccacacatctacaaccatctgatctttgacgaccctgagaaaaacaagcaatagggaaaggattccctatttaataaatggttctgggaaaactggctagccatatgcagaaaacaaaaactggaccccttgcttacatcttttaactcaagatggattaaagacttaaaagtaaaacctaaaaccttaaaaatcctagaagaaaacctaggcaatatcattcaggacagaggcctgggcaaagactttatgactaaaacaccaaaggcaattacaacaaaagccagaattgacaaatgagatctaattaaactaaagaacttctgcacagcaaaagaaactatcatcagagtgaacaggcaacctacagaatgggagagaatttttgcaatctatccatctgacaaagagctaatatgcagaatctacaaggaacttaaacaaatttacaagaaaaaaaaaaaaacaaccccatcaaaaagtgggcaaaaagaagacatttatgcagccaacacacatatgaaaaaaagcccaacatcactggtcattagagaaatgcaaatcaacaccacaatgagataccatctcatgccagttagaatggcaatcattaaaaagtcaggaaacaacagatgctaaagaggatgtggagaaataggaacgcttttacactgttggttggagtgtaaattagttcaaccattgtggaagacagtgtggtgattcctcaagggtctagaaccagaaataccatttgacccagccatcccattactgggtatacacccaaaggattataaatcattctactataaagacacatgcacatgtatgtttactgcagcactatttacaataacaaagacttggaaccaacccaaatgcccatgaatgatagactgaataaagaaaatgtggcacatatacaccacggaatactatgcagccataaaaaggaatgaactcatgtcctttgcggggacatggatgaagctggaaaccatcatcctcagcaaactaacacaggaaccaaacactgcacattctcactcataagtgggagttgaacaatgagaacacatggacagaggaaggggaacgtcacacaccagggcctttcagggggtggagggggaaaggggagggagagcattagggcaaatatctaatgcatacggggcttaaaacctagatgatgggttgataggtgcagcaaaccaccatggcacatgtacacctacgtaaggaacctgcatgttcagcacatgtatcccagaacttaaagtaaaattgtttttaaaaaagtttttttaaattattccaagtaaaaagagacagactccctcccaagatattgtctgactcaatttacgttaaaactctagaaaatacaaactagtttatagtgacatagggcaaatcagtacttgcttgaaggggagattagtgtaggagggattacaaagggcaaaaggatgatgtggggcatgatggatatgtttactattttgttagtggatggttcatggacatcagttaaatactttatatgtatacagcttattttatctcagttattctcctgttttaaaaataaattattaaacactaataacaactgaagggagatctggttgatcatagtgattggtattagctaaacactgtcctttcagtgctatgattatatctttgttttaatagacttcattttttagagtagtttaagattcacagaaaaactgagcagaaagtacagagttctcatatactccttgcccccacatgtatacctccctcaccatcaacatcctgtaccacaatggtacatttgtcacaattagcgagcctatatgtatacattattatcactcaaagtccactgtttccattatactcttggtgctgtacattgtatggattttgacaaatgcataatgatgtgtatttgccattatcgtattatatagagtactttcattgccccaaaaatattctgtgctctgcctattcatctgtccctcaccatgaatctctggcaacctctgatctttctactgtcaccaaagttttgctttttccagaatatcatagtgttggaatcatagaatatgtagccttttcagattggcttctttcacttggtaatatgaacattcactttttaaccatagtactgtatttgatatacagctacatatgtaattattttatttcaagtctatgtttgtgagcccctggttagctgagtgtagacattctcaagagggggaaagggatgtggcc

SEQ ID NO: 8 - DNA, 33623 bp, Homo sapiens
actgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccatatgatcatttcaacgatgcagaaaaaaagtttcataaagccaccatcattactgataaaacctgtcaacaaggaagatacatagatgaaaaataagcacaggaagagatacttaatgtcattaaacactaagaaaatgcaaactaaaaccacagcaagataccattaccatctattaaagtggctaaaattacaaagactgacaatagcaagtgttggtgaggatgtggagggaaggaattctcatacactgctcatgggactgtcaaataatatggtcactttggaaaacagttcagtagttcctttaaaagttcaacagtcactaaccatatgatccagcatggccttctaattatttttccaagagaaaaggaaatctgtgaatgttcatagcagctttatttgtaatagccaaaatttgaaaacaacacaaagctcaccaattgataacaaattatgatatatccatgcaaataaagtgctactcggaaataaaaaagaatattgttatacacacaaaatcattaaatctcacagaaattattacaagtagtgcttgctttggcagcacgtttagtaaaattggaatgatacagagattagcgtggcccctgcacaaggaggacatgcaaattcatgaagtgttccatattttaaatttaattttatgataaagaaaaacattggagggctgggcgtggtggctcacgcctgtaatcccagcactttgggaggccgaggtgggtggatcacaaggtcaggagactgagaccatcctggctaacatgatgaaaccccgtctctactaaaaatacaaaaaattagctgggcatggtggtggacacctgtagtcccagctactcgggaggctgaggcaggagaatggcgtgaacccagggggcggagcttgcagtgagccgagatggcgccactgcactccaacctgggcaacagagcgagactccgtctcaaaaaaaaaaaaaaaagaaaagaaaagaaaagaaaaacatgggaaggatctggcaagatgtctgaataggaacgctctggcctgccagcgagaccaatgcagaaggcaggggatttctgcatttccaactgaggtaccctgttcatctcattgggactggttaggcagtgggtgcagcccatggaaggcaggcagaagcagggcggggtgttgcctcaacccaggaagtgcaaggagtggggggcctccctccaccagccaagggaagctgtgagggactgtgctatctggcccagacactacgcgtttcccacggtttttgcaatccacagaacaggagagtccctcatgtgactacaccaccagggccctgggtttcaagcacaaaactgggtggctgtttgggcagacactgagccagctgcaggagtgtttttttataccctagtggcgcctggaaccacagcaagacagaactgttcaccccctggaaagggggctgaagctagggagccaagtgggctcactcagcgggtcccactcccacggagcccagcaagctaagagccactggcttgaaattcctgctgccagcacagtagtctggagctgacctggagcttggttgggggaggggcatctgtcattactggggcttgaataggtggttttcccctgacagtgctaaggaggcctggaagttcggactgggcggaactcaacacagcacggcaaagaggctgtggccagactgcctctctagattcctcctcactgggcagggcatctctgaaagaaaggcagcagtcccagtcaggggcttatagataaaagtcccaactcccttggacagagcacctgggggaaggggcggctgtgggtgcagcttcagtggacttaaacgttcctgcctgctggctctgcagagagcagcagatgctgacaaggagggctctcccagcacagcactcgagctctgctaagggacagactgcctcctcaagtgggtccctgacccctgtgtcacctgacggggagagacctcccaacaggggttgacagacacctcatacaggagagctctggttggcatcaggctggtgcccctctaagatgaagcttccagaggaaggagcaggcagcaatctttgctgttctgcagcctccactggttatacccaggcaaatagggtctggagtggacctccagcaaactgcagcagacctgcagaaaaggggtctgactgttagaagaaaaactaacaaacagaaagcagtaacatcaacatcaacaaaaggatccccacacaaaaaccccaaccacaggtcatcagcctcaaagatcaaaggtagataaatccacaaagatgaggaaaaaccagcttaaaaatgctggaaatttcaaaaatcagaatgcctcttccccaaatgatcataactcctgtctagtaagggcacaaaactggacagaaaatgagtttgaaagaattgccaaattgacagaagtaggcttcagcatatgggtaataacaaactcctctgaggtaagggagcatgttctagccaaatgcaaggaagctaagaacgttgacaaggttataggaatggctaactaggataaccagtttagaggagaacataaatgacctcatggagctgaaaaagacagcacgagaacttcgtgaagcatacacaagtatcaatagccgaatcgatcaagaggaagaaaggatgtgagagactgaagaacaacttactgaaatagggcatgaagacaagattagagaaaaagaatgaaaaggaacaaacaaagcctccaagaaatatgggagtatgtgaaaagaccaaacctatgattgatcagggtccctgaaagtgatggggagaatggaaccaagttggaaaacacacttcagaatattacccaggagaacttccccaacctagcaagacaggccaacattcaaattcaggaaatacagagaatgccacaaagatactcctcgagaagagcaaccccaagacacataatcgtcagattcaccaaggttgaaatgaaggaaaaaatgttaaggtcagccagagagaagggtcaggttacctacaaagggaagcccatcagatgaacagtggatctctctgcagaaaccctagaagccagaagagagtgagggccaatattcaacattcttaaaaaaattttcaacccagaattccatatccagccaaactaagcttcataaatgagggagaaatatagtcctttacagacaagcaaatgctgagggattttgtcaccaccaatcctgccctacaagagctcctgaaggaagcactaaatatggaaaggaacaactggtaccagccaccacaaaaacacaccagaatataaagaccaatgacactatgaaaaaactgcataaaggaatgtgcaaaataaccagcaagcgtcatgatgaccggatcaaatttacacataacaatattaaccttaaatgtaaatgggctaactgccccaattaaaagacacagactggcaaattggataaagagtcaagacccatcggtgtgctgcattcaggagacccatctcatatgcaaagacacacatcggctcaaaataaagggatggaggaatatttaccaagcaaatggaaagcaaaaagagcaggggctgcaatcctagtctctgataaaacagactttaaagcaacaaagacaaaggagggcattaaataatggtaaagggatcaatgcaataagaagagctaactatcctaaatatatatgcacctaatacaggagcactcagattcataaaagaagttcttagagacatacaaagagacttaggctcccacgcaataatagtgggagagtttaacaccccactgtcaatattagatcaacgagacagaaaattaataaggatattcaggacttgaactcagctctggaccaaacagacctaacagacatctacagaactctccaccccaaatcagcagaatatacattcttctaagaaccacatagcacttattctaaaatcggtcacataattggaagtaaaacactcctcagcaaatgcaaaagaacggaaatcataacagtctctcagaccacagtgcagtcaaattagaacccaggattaagaaactcactcaaaaccacacaattacatggaaactgaacaagctgctcctgaatgactactggatgaatgacaaaattaaggcagaaataaaaaagttatttgaaaccaatgagaacaaagacgcaacataccaaaatctctgggacacagctaaagcagtattaagagaaaaatttatagcactaaatgcctacagcagaaagtggaaaagatgtaaaattgacactctaacatcacaattaaaagaactagagaagcaagagcaaacaaattgaaaagctagcagaagacaagaaataattaatatcagagcagaagtgaaggagatagagacacaaaaaacccttcaaaaaaatcaatgaatccaggagttggttttgtgaaaagattaacaaaatagaccactagctagactaatatagaggaaaagagagaagaatcaaatagacacaataaaaaatgataaaggggatatcaccactgatcccacagaaatacaaactaccatccgagaatactataaacacctctatgcaaataaactagaaaatctagaagaaatggataaatttctggacacatacaccctcccaacactaaaccaggaagaaatcgaatccctcaatagaccagtaacaagttctgaaattcaggcagtaattaatagcctactaacaacaacaaaaagcccaggaccagacagattcacagaccaattctaccagaggtacaaagaggagctggtactattccttctgaaactattccaaacaatagaaaaagagggactcctccctaactcattttatgaggccagcatcatcctgattccaaaacctggcaaagacacaataaaaaaggaaaatttcaggtcaatatgcctaatgaacatctatgcgaaaatcctcaacaaaaatgggcaaatagaatccagcagcacatcaaaaagcttatccaccatgatcaggtgggcttcatctctggaatgaaagcctggttcaacatatgcaaatcaataaacataatcaatacataaagagaacaaatgacaaaaactacatgattagctcaacagatgcagaaaaggccttcaataaaattcaacgccccttcatgctaaaaattcttaataaactaggtatcgatggaaggtatcccaaaataataacagctatttatgacaaacccacagccagaatcatactgaatgggcaaaaactggaagcattccctttgaaaactggcacaagacaaggatgccctctctcaccactcctattcaacacagtaatggaagttctggcctgggcaatcaggcaagagaaagaaataaagggtattcagataggaaggcaggaaatcaaattgtctctgtttgcagatgacattattgtatatttagaaaaccccatcgtctcagcccaaaatctccttaagctgataagcaacttcagcgaaatctcaggatacaaaatcaatatgcaaaaatcaccagcattccaaatcaataaatgtaatccatcacataaacagaacctataacaaatccacatgattatctgaatagatgcagaaaaggcctttgacaaaattcaacacccttcatgctaaaaactctcaataaacttggtatcaatggaatgtatctcaaaacagtaacagctatttatgacaaacccacagccaatatcatactgaatgggcaaaaactgaaagcattccctttgaaaaccagcacaagacaaggatgccctctcttaccactcctattcaacatagtattggaagttctggtcagggcaatcaggcaagagaaagaaataaaaggtattcaaataggaaaagaggaagtcaaatagtctctatttgcagatgacatgactgtatatttagaaaaccccatcatctcagccccaaatctccttaagctgataagcaagttcagcaaactttcaggatacagaatcaatgtgcaaaaatcacaagcattcctgtacacaaataacagacaaacagagagccaaatcatgagtgaactcccattcacaattgctacaaagagaataaaatacctaggaatccaacttacaagggatgtgaaggacctcttcaaggacaactacaaaccattgctcaaggaaataagagaggacacaaatggaaaagcaatccatgctcatggataggaacaatattgtgaaaatggccatactgctcaaagtaatttatagattcaatgctatccccatcaagctaccactgactttctttacagaattggaaagaactactttaactccatatggaaccaaaaaagagcccgcatagccaagacaatcctgggcaagaagaacaaagctggaggcatcatgctacctgacttcaaacaatactacaaggctagctacagtaacaaaaacagcatggtaccggtaccaaaacagatacttaggccaatggaacagaacagagaggcctcagaaataacatcacacatctacaaccaactgatctttgacaaacctgacacaaacaagcaatggggaaaatattccctgtttaataaatggtgctgggaaaactggctagccatatgcagaagcctgaaactggaccccttcctcacaccttatacaaaaattaactcaagatggatcaaagacttaaacgtaagacctaggtccataaaaatcctagaagaaaacctgggcaataccattcaggatgtaggcatgggcaaagactttatctctaaagcaccaaaagcaatggcaacaaaaaccgaaattagaatttctctgatgactagtgatgatgagcattttttcgtgtgtccgttggctgcataaatgtcttcttttgagaagtgtctgttcatatcctttgcccactttttgatggggttgtttgttttcttcttgtaaatttgtttaagttctttgtagattctggatatcagccctttgtcagatggatagattgcaaaaattttttcccattctgtaggttgcctgatcactctgatggtagtttctcttgctgtgcagaagctctttagtttaattagatcccatatgtcaattttggcttttgttgcccttgcttttggtgttttagtcatcaagtctttgcccatgcctatgtcctgaatgatattgcctaggttttcttctagggattttatggttttaggtctaaaatttaagtctttaatccatcatgaactaatttttgtataaggtgtaaggaagggatccagtttcaactttctacatatggctagccagttttcccaacaccatttattaaatagggaatccttttcccactgcttgtttgtgtcaggtctgtcaaagatcagatggttgtagatgtgaggtgttatttctgaggcctctgttccattccattggtctatatatctgttttggtaccagtaccatactgtagccttgtagtatagtttgaagtcaggtagagtgatgcctccagctttgttcattttgcttaggattgtcttggctatgcaggctctttctttggttccatatgaactttaaagtagttttttccaattctgtgaagaaagtcattggataccatctcaggctggttagaatggtgatcattaaaaatcaggcaacaacagatgctaaagaggatgtggagaaataggaatgcttttacactgttggtgggagtgtaaatttgttcaaccattgtggaacacagtgtggtgattcctcaaggatctagaactagaaataccatttgactcagcgatcccattactgggtatatacccaaagaattataaatcatgctagtataaagacacatgcacatgtatgtttattgtggcactattcacaatagcaaagacttggaacccacccaaatgtccatcaatgacaggctggattaagaaaatgtggcacatatacaccatggaatactatgcagccataaaaaaggatgagttcatgtcctttgcagggacatggatgaagctggaaaccaccattctcagcaaactatcacaaggatggaaaatcaaacaccacatattctcactcataggtgggaactgaacaatgagaacacttggacacagggtggggaacatcacacactggggcctgtcaggggttagggagctgggggagggatagcattaggagaaatacctaatgtaaatgatgagttgttgggtgcagcaaaccaccatggcacatgtatacatatgtaacaaacctgcacattgtgcacatgtaccgtagaacttaaaatataatttaaaaaacaaaaaaacaaaattgacaaatgggatctaattaaactaaagagcttctgcatagcaaaagaaactatcatcagagttaacaggcaacctacagaatgggagaaaaattttgcaatctatccatctgacaaagggcaaatatccagaatctacaaagaacttaaacaaatttacaagaaaaaacaaacaaccccatcaaaaagtgggcaaagtatatgaacagaaacttctgaaaagaagactttaatgcagccaacagacatatgaaaaaattctcatcatcgctggtcatttagagaaatgcaaatcaaaaacaacaatgagatactatctcaggccagttagaatggcaatcattaaaaagtcaggaaacaacagacgctggataggatgtggagaaatagaaacatttttacattgttggtgggagtataaattagttcaaccattgtggaagacagtgtggtgattcctcaaggatctagagctagaaataccatttgacccagcaatcccattactgggtatatacccaaagaattataaatcattctactataaagacacatgcacatgtatgtttattgcagcacaattcacaatagcaaagacatggaaccaacccaaatatccatcaataatagactggataaagaaaatgtgccacgtatacaccatggaatactatgcagccataaaaaaaggatgagttcatgtcctttgcagggaccggatgaagctggaaaccaccattctcagcacactatcagaagaacagaaaaccaaacactgcattttctcactcgtaagtgggagttgaacaatgagaacacaaggacatagggaggggagcatcacataccagggcctgtcaggaggtggggggctaggggagggatgacattaggagtgatacttaatgaaggtgatgggttgataggtgcagcaaaccaccatggcatgtgtatacctatgtaacaaaactgcgcattctgcccatgtagcccagaacttaaagtataataataaaaaaaaatcaccagcattcctatacacaaaaaataaacaagcagaaaaccaaatcatgagtgaactctcattcacaattgctacaaagaaaataaaatacctaggaatacaacttacaagggacatgaaggaactcttcaaggagaactacaaaccactgctcaaggaaataagaaaggacaaaaacaaatggaaaaaacattccatgctcatggataggaagaatcaatatcatgaaatggccatactgcccaaagttatttatagattcaatgctactcccatcaagctaccattaactttcctcatagaactagaaaaaactactttaaatttcatatggaacctaaaaagagcccgtatggccaaggcaatcctaagcaaaaagaacaaagttggaagcatcatgctacccgactacaaggctacagtaacaaaaacagcatggtactggtaccaaaacagatatatagaccaatggaacagaacagatgccccagaaaaacaccacacatctacaaccatctgatctttgacgaccctgagaaaaacaagcaatagggaaaggattccctatttaataaatggttctgggaaaactggctagccatatgcagaaaacaaaaactggaccccttgcttacatcttttaactcaagatggattaaagacttaaaagtaaaacctaaaaccttaaaaatcctagaagaaaacctaggcaatatcattcaggacagaggcctgggcaaagactttatgactaaaacaccaaaggcaattacaacaaaagccagaattgacaaatgagatctaattaaactaaagaacttctgcacagcaaaagaaactatcatcagagtgaacaggcaacctacagaatgggagagaatttttgcaatctatccatctgacaaagagctaatatgcagaatctacaaggaacttaaacaaatttacaagaaaaaaaaaaaaacaaccccatcaaaaagtgggcaaaaagaagacatttatgcagccaacacacatatgaaaaaaagcccaacatcactggtcattagagaaatgcaaatcaacaccacaatgagataccatctcatgccagttagaatggcaatcattaaaaagtcaggaaacaacagatgctaaagaggatgtggagaaataggaacgcttttacactgttggttggagtgtaaattagttcaaccattgtggaagacagtgtggtgattcctcaagggtctagaaccagaaataccatttgacccagccatcccattactgggtatacacccaaaggattataaatcattctactataaagacacatgcacatgtatgtttactgcagcactatttacaataacaaagacttggaaccaacccaaatgcccatgaatgatagactgaataaagaaaatgtggcacatatacaccacggaatactatgcagccataaaaaggaatgaactcatgtcctttgcggggacatggatgaagctggaaaccatcatcctcagcaaactaacacaggaaccaaacactgcacattctcactcataagtgggagttgaacaatgagaacacatggacagaggaaggggaacgtcacacaccagggcctttcagggggtggagggggaaaggggagggagagcattagggcaaatatctaatgcatacggggcttaaaacctagatgatgggttgataggtgcagcaaaccaccatggcacatgtacacctacgtaaggaacctgcatgttcagcacatgtatcccagaacttaaagtaaaattgtttttaaaaaagtttttttaaattattccaagtaaaaagagacagactccctcccaagatattgtctgactcaatttacgttaaaactctagaaaatacaaactagtttatagtgacatagggcaaatcagtacttgcttgaaggggagattagtgtaggagggattacaaagggcaaaaggatgatgtggggcatgatggatatgtttactattttgttagtggatggttcatggacatcagttaaatactttatatgtatacagcttattttatctcagttattctcctgttttaaaaataaattattaaacactaataacaactgaagggagatctggttgatcatagtgattggtattagctaaacactgtcctttcagtgctatgattatatctttgttttaatagacttcattttttagagtagtttaagattcacagaaaaactgagcagaaagtacagagttctcatatactccttgcccccacatgtatacctccctcaccatcaacatcctgtaccacaatggtacatttgtcacaattagcgagcctatatgtatacattattatcactcaaagtccactgtttccattatactcttggtgctgtacattgtatggattttgacaaatgcataatgatgtgtatttgccattatcgtattatatagagtactttcattgccccaaaaatattctgtgctctgcctattcatctgtccctcaccatgaatctctggcaacctctgatctttctactgtcaccaaagttttgctttttccagaatatcatagtgttggaatcatagaatatgtagccttttcagattggcttctttcacttggtaatatgaacattcactttttaaccatagtactgtatttgatatacagctacatatgtaattattttatttcaagtctatgtttgtgagcccctggttagctgagtgtagacattctcaagagggggaaagggatgtggcc

SEQ ID NO: 9 - DNA, 34700 bp, Homo sapiens
actgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccatatgatcatttcaacgatgcagaaaaaaagtttcataaagccaccatcattactgataaaacctgtcaacaaggaagatacatagatgaaaaataagcacaggaagagatacttaatgtcattaaacactaagaaaatgcaaactaaaaccacagcaagataccattaccatctattaaagtggctaaaattacaaagactgacaatagcaagtgttggtgaggatgtggagggaaggaattctcatacactgctcatgggactgtcaaataatatggtcactttggaaaacagttcagtagttcctttaaaagttcaacagtcactaaccatatgatccagcatggccttctaattatttttccaagagaaaaggaaatctgtgaatgttcatagcagctttatttgtaatagccaaaatttgaaaacaacacaaagctcaccaattgataacaaattatgatatatccatgcaaataaagtgctactcggaaataaaaaagaatattgttatacacacaaaatcattaaatctcacagaaattattacaagtagtgcttgctttggcagcacgtttagtaaaattggaatgatacagagattagcgtggcccctgcacaaggaggacatgcaaattcatgaagtgttccatattttaaatttaattttatgataaagaaaaacattggagggctgggcgtggtggctcacgcctgtaatcccagcactttgggaggccgaggtgggtggatcacaaggtcaggagactgagaccatcctggctaacatgatgaaaccccgtctctactaaaaatacaaaaaattagctgggcatggtggtggacacctgtagtcccagctactcgggaggctgaggcaggagaatggcgtgaacccagggggcggagcttgcagtgagccgagatggcgccactgcactccaacctgggcaacagagcgagactccgtctcaaaaaaaaaaaaaaaagaaaagaaaagaaaagaaaaacatgggaaggatctggcaagatgtctgaataggaacgctctggcctgccagcgagaccaatgcagaaggcaggggatttctgcatttccaactgaggtaccctgttcatctcattgggactggttaggcagtgggtgcagcccatggaaggcaggcagaagcagggcggggtgttgcctcaacccaggaagtgcaaggagtggggggcctccctccaccagccaagggaagctgtgagggactgtgctatctggcccagacactacgcgtttcccacggtttttgcaatccacagaacaggagagtccctcatgtgactacaccaccagggccctgggtttcaagcacaaaactgggtggctgtttgggcagacactgagccagctgcaggagtgtttttttataccctagtggcgcctggaaccacagcaagacagaactgttcaccccctggaaagggggctgaagctagggagccaagtgggctcactcagcgggtcccactcccacggagcccagcaagctaagagccactggcttgaaattcctgctgccagcacagtagtctggagctgacctggagcttggttgggggaggggcatctgtcattactggggcttgaataggtggttttcccctgacagtgctaaggaggcctggaagttcggactgggcggaactcaacacagcacggcaaagaggctgtggccagactgcctctctagattcctcctcactgggcagggcatctctgaaagaaaggcagcagtcccagtcaggggcttatagataaaagtcccaactcccttggacagagcacctgggggaaggggcggctgtgggtgcagcttcagtggacttaaacgttcctgcctgctggctctgcagagagcagcagatgctgacaaggagggctctcccagcacagcactcgagctctgctaagggacagactgcctcctcaagtgggtccctgacccctgtgtcacctgacggggagagacctcccaacaggggttgacagacacctcatacaggagagctctggttggcatcaggctggtgcccctctaagatgaagcttccagaggaaggagcaggcagcaatctttgctgttctgcagcctccactggttatacccaggcaaatagggtctggagtggacctccagcaaactgcagcagacctgcagaaaaggggtctgactgttagaagaaaaactaacaaacagaaagcagtaacatcaacatcaacaaaaggatccccacacaaaaaccccaaccacaggtcatcagcctcaaagatcaaaggtagataaatccacaaagatgaggaaaaaccagcttaaaaatgctggaaatttcaaaaatcagaatgcctcttccccaaatgatcataactcctgtctagtaagggcacaaaactggacagaaaatgagtttgaaagaattgccaaattgacagaagtaggcttcagcatatgggtaataacaaactcctctgaggtaagggagcatgttctagccaaatgcaaggaagctaagaacgttgacaaggttataggaatggctaactaggataaccagtttagaggagaacataaatgacctcatggagctgaaaaagacagcacgagaacttcgtgaagcatacacaagtatcaatagccgaatcgatcaagaggaagaaaggatgtgagagactgaagaacaacttactgaaatagggcatgaagacaagattagagaaaaagaatgaaaaggaacaaacaaagcctccaagaaatatgggagtatgtgaaaagaccaaacctatgattgatcagggtccctgaaagtgatggggagaatggaaccaagttggaaaacacacttcagaatattacccaggagaacttccccaacctagcaagacaggccaacattcaaattcaggaaatacagagaatgccacaaagatactcctcgagaagagcaaccccaagacacataatcgtcagattcaccaaggttgaaatgaaggaaaaaatgttaaggtcagccagagagaagggtcaggttacctacaaagggaagcccatcagatgaacagtggatctctctgcagaaaccctagaagccagaagagagtgagggccaatattcaacattcttaaaaaaattttcaacccagaattccatatccagccaaactaagcttcataaatgagggagaaatatagtcctttacagacaagcaaatgctgagggattttgtcaccaccaatcctgccctacaagagctcctgaaggaagcactaaatatggaaaggaacaactggtaccagccaccacaaaaacacaccagaatataaagaccaatgacactatgaaaaaactgcataaaggaatgtgcaaaataaccagcaagcgtcatgatgaccggatcaaatttacacataacaatattaaccttaaatgtaaatgggctaactgccccaattaaaagacacagactggcaaattggataaagagtcaagacccatcggtgtgctgcattcaggagacccatctcatatgcaaagacacacatcggctcaaaataaagggatggaggaatatttaccaagcaaatggaaagcaaaaagagcaggggctgcaatcctagtctctgataaaacagactttaaagcaacaaagacaaaggagggcattaaataatggtaaagggatcaatgcaataagaagagctaactatcctaaatatatatgcacctaatacaggagcactcagattcataaaagaagttcttagagacatacaaagagacttaggctcccacgcaataatagtgggagagtttaacaccccactgtcaatattagatcaacgagacagaaaattaataaggatattcaggacttgaactcagctctggaccaaacagacctaacagacatctacagaactctccaccccaaatcagcagaatatacattcttctaagaaccacatagcacttattctaaaatcggtcacataattggaagtaaaacactcctcagcaaatgcaaaagaacggaaatcataacagtctctcagaccacagtgcagtcaaattagaacccaggattaagaaactcactcaaaaccacacaattacatggaaactgaacaagctgctcctgaatgactactggatgaatgacaaaattaaggcagaaataaaaaagttatttgaaaccaatgagaacaaagacgcaacataccaaaatctctgggacacagctaaagcagtattaagagaaaaatttatagcactaaatgcctacagcagaaagtggaaaagatgtaaaattgacactctaacatcacaattaaaagaactagagaagcaagagcaaacaaattgaaaagctagcagaagacaagaaataattaatatcagagcagaagtgaaggagatagagacacaaaaaacccttcaaaaaaatcaatgaatccaggagttggttttgtgaaaagattaacaaaatagaccactagctagactaatatagaggaaaagagagaagaatcaaatagacacaataaaaaatgataaaggggatatcaccactgatcccacagaaatacaaactaccatccgagaatactataaacacctctatgcaaataaactagaaaatctagaagaaatggataaatttctggacacatacaccctcccaacactaaaccaggaagaaatcgaatccctcaatagaccagtaacaagttctgaaattcaggcagtaattaatagcctactaacaacaacaaaaagcccaggaccagacagattcacagaccaattctaccagaggtacaaagaggagctggtactattccttctgaaactattccaaacaatagaaaaagagggactcctccctaactcattttatgaggccagcatcatcctgattccaaaacctggcaaagacacaataaaaaaggaaaatttcaggtcaatatgcctaatgaacatctatgcgaaaatcctcaacaaaaatgggcaaatagaatccagcagcacatcaaaaagcttatccaccatgatcaggtgggcttcatctctggaatgaaagcctggttcaacatatgcaaatcaataaacataatcaatacataaagagaacaaatgacaaaaactacatgattagctcaacagatgcagaaaaggccttcaataaaattcaacgccccttcatgctaaaaattcttaataaactaggtatcgatggaaggtatcccaaaataataacagctatttatgacaaacccacagccagaatcatactgaatgggcaaaaactggaagcattccctttgaaaactggcacaagacaaggatgccctctctcaccactcctattcaacacagtaatggaagttctggcctgggcaatcaggcaagagaaagaaataaagggtattcagataggaaggcaggaaatcaaattgtctctgtttgcagatgacattattgtatatttagaaaaccccatcgtctcagcccaaaatctccttaagctgataagcaacttcagcgaaatctcaggatacaaaatcaatatgcaaaaatcaccagcattccaaatcaataaatgtaatccatcacataaacagaacctataacaaatccacatgattatctgaatagatgcagaaaaggcctttgacaaaattcaacacccttcatgctaaaaactctcaataaacttggtatcaatggaatgtatctcaaaacagtaacagctatttatgacaaacccacagccaatatcatactgaatgggcaaaaactgaaagcattccctttgaaaaccagcacaagacaaggatgccctctcttaccactcctattcaacatagtattggaagttctggtcagggcaatcaggcaagagaaagaaataaaaggtattcaaataggaaaagaggaagtcaaatagtctctatttgcagatgacatgactgtatatttagaaaaccccatcatctcagccccaaatctccttaagctgataagcaagttcagcaaactttcaggatacagaatcaatgtgcaaaaatcacaagcattcctgtacacaaataacagacaaacagagagccaaatcatgagtgaactcccattcacaattgctacaaagagaataaaatacctaggaatccaacttacaagggatgtgaaggacctcttcaaggacaactacaaaccattgctcaaggaaataagagaggacacaaatggaaaagcaatccatgctcatggataggaacaatattgtgaaaatggccatactgctcaaagtaatttatagattcaatgctatccccatcaagctaccactgactttctttacagaattggaaagaactactttaactccatatggaaccaaaaaagagcccgcatagccaagacaatcctgggcaagaagaacaaagctggaggcatcatgctacctgacttcaaacaatactacaaggctagctacagtaacaaaaacagcatggtaccggtaccaaaacagatacttaggccaatggaacagaacagagaggcctcagaaataacatcacacatctacaaccaactgatctttgacaaacctgacacaaacaagcaatggggaaaatattccctgtttaataaatggtgctgggaaaactggctagccatatgcagaagcctgaaactggaccccttcctcacaccttatacaaaaattaactcaagatggatcaaagacttaaacgtaagacctaggtccataaaaatcctagaagaaaacctgggcaataccattcaggatgtaggcatgggcaaagactttatctctaaagcaccaaaagcaatggcaacaaaaaccgaaattagaatttctctgatgactagtgatgatgagcattttttcgtgtgtccgttggctgcataaatgtcttcttttgagaagtgtctgttcatatcctttgcccactttttgatggggttgtttgttttcttcttgtaaatttgtttaagttctttgtagattctggatatcagccctttgtcagatggatagattgcaaaaattttttcccattctgtaggttgcctgatcactctgatggtagtttctcttgctgtgcagaagctctttagtttaattagatcccatatgtcaattttggcttttgttgcccttgcttttggtgttttagtcatcaagtctttgcccatgcctatgtcctgaatgatattgcctaggttttcttctagggattttatggttttaggtctaaaatttaagtctttaatccatcatgaactaatttttgtataaggtgtaaggaagggatccagtttcaactttctacatatggctagccagttttcccaacaccatttattaaatagggaatccttttcccactgcttgtttgtgtcaggtctgtcaaagatcagatggttgtagatgtgaggtgttatttctgaggcctctgttccattccattggtctatatatctgttttggtaccagtaccatactgtagccttgtagtatagtttgaagtcaggtagagtgatgcctccagctttgttcattttgcttaggattgtcttggctatgcaggctctttctttggttccatatgaactttaaagtagttttttccaattctgtgaagaaagtcattggataccatctcaggctggttagaatggtgatcattaaaaatcaggcaacaacagatgctaaagaggatgtggagaaataggaatgcttttacactgttggtgggagtgtaaatttgttcaaccattgtggaacacagtgtggtgattcctcaaggatctagaactagaaataccatttgactcagcgatcccattactgggtatatacccaaagaattataaatcatgctagtataaagacacatgcacatgtatgtttattgtggcactattcacaatagcaaagacttggaacccacccaaatgtccatcaatgacaggctggattaagaaaatgtggcacatatacaccatggaatactatgcagccataaaaaaggatgagttcatgtcctttgcagggacatggatgaagctggaaaccaccattctcagcaaactatcacaaggatggaaaatcaaacaccacatattctcactcataggtgggaactgaacaatgagaacacttggacacagggtggggaacatcacacactggggcctgtcaggggttagggagctgggggagggatagcattaggagaaatacctaatgtaaatgatgagttgttgggtgcagcaaaccaccatggcacatgtatacatatgtaacaaacctgcacattgtgcacatgtaccgtagaacttaaaatataatttaaaaaacaaaaaaacaaaattgacaaatgggatctaattaaactaaagagcttctgcatagcaaaagaaactatcatcagagttaacaggcaacctacagaatgggagaaaaattttgcaatctatccatctgacaaagggcaaatatccagaatctacaaagaacttaaacaaatttacaagaaaaaacaaacaaccccatcaaaaagtgggcaaagtatatgaacagaaacttctgaaaagaagactttaatgcagccaacagacatatgaaaaaattctcatcatcgctggtcatttagagaaatgcaaatcaaaaacaacaatgagatactatctcaggccagttagaatggcaatcattaaaaagtcaggaaacaacagacgctggataggatgtggagaaatagaaacatttttacattgttggtgggagtataaattagttcaaccattgtggaagacagtgtggtgattcctcaaggatctagagctagaaataccatttgacccagcaatcccattactgggtatatacccaaagaattataaatcattctactataaagacacatgcacatgtatgtttattgcagcacaattcacaatagcaaagacatggaaccaacccaaatatccatcaataatagactggataaagaaaatgtgccacgtatacaccatggaatactatgcagccataaaaaaaggatgagttcatgtcctttgcagggaccggatgaagctggaaaccaccattctcagcacactatcagaagaacagaaaaccaaacactgcattttctcactcgtaagtgggagttgaacaatgagaacacaaggacatagggaggggagcatcacataccagggcctgtcaggaggtggggggctaggggagggatgacattaggagtgatacttaatgaaggtgatgggttgataggtgcagcaaaccaccatggcatgtgtatacctatgtaacaaaactgcgcattctgcccatgtagcccagaacttaaagtataataataaaaaaaaatcaccagcattcctatacacaaaaaataaacaagcagaaaaccaaatcatgagtgaactctcattcacaattgctacaaagaaaataaaatacctaggaatacaacttacaagggacatgaaggaactcttcaaggagaactacaaaccactgctcaaggaaataagaaaggacaaaaacaaatggaaaaaacattccatgctcatggataggaagaatcaatatcatgaaatggccatactgcccaaagttatttatagattcaatgctactcccatcaagctaccattaactttcctcatagaactagaaaaaactactttaaatttcatatggaacctaaaaagagcccgtatggccaaggcaatcctaagcaaaaagaacaaagttggaagcatcatgctacccgactacaaggctacagtaacaaaaacagcatggtactggtaccaaaacagatatatagaccaatggaacagaacagatgccccagaaaaacaccacacatctacaaccatctgatctttgacgaccctgagaaaaacaagcaatagggaaaggattccctatttaataaatggttctgggaaaactggctagccatatgcagaaaacaaaaactggaccccttgcttacatcttttaactcaagatggattaaagacttaaaagtaaaacctaaaaccttaaaaatcctagaagaaaacctaggcaatatcattcaggacagaggcctgggcaaagactttatgactaaaacaccaaaggcaattacaacaaaagccagaattgacaaatgagatctaattaaactaaagaacttctgcacagcaaaagaaactatcatcagagtgaacaggcaacctacagaatgggagagaatttttgcaatctatccatctgacaaagagctaatatgcagaatctacaaggaacttaaacaaatttacaagaaaaaaaaaaaaacaaccccatcaaaaagtgggcaaaaagaagacatttatgcagccaacacacatatgaaaaaaagcccaacatcactggtcattagagaaatgcaaatcaacaccacaatgagataccatctcatgccagttagaatggcaatcattaaaaagtcaggaaacaacagatgctaaagaggatgtggagaaataggaacgcttttacactgttggttggagtgtaaattagttcaaccattgtggaagacagtgtggtgattcctcaagggtctagaaccagaaataccatttgacccagccatcccattactgggtatacacccaaaggattataaatcattctactataaagacacatgcacatgtatgtttactgcagcactatttacaataacaaagacttggaaccaacccaaatgcccatgaatgatagactgaataaagaaaatgtggcacatatacaccacggaatactatgcagccataaaaaggaatgaactcatgtcctttgcggggacatggatgaagctggaaaccatcatcctcagcaaactaacacaggaaccaaacactgcacattctcactcataagtgggagttgaacaatgagaacacatggacagaggaaggggaacgtcacacaccagggcctttcagggggtggagggggaaaggggagggagagcattagggcaaatatctaatgcatacggggcttaaaacctagatgatgggttgataggtgcagcaaaccaccatggcacatgtacacctacgtaaggaacctgcatgttcagcacatgtatcccagaacttaaagtaaaattgtttttaaaaaagtttttttaaattattccaagtaaaaagagacagactccctcccaagatattgtctgactcaatttacgttaaaactctagaaaatacaaactagtttatagtgacatagggcaaatcagtacttgcttgaaggggagattagtgtaggagggattacaaagggcaaaaggatgatgtggggcatgatggatatgtttactattttgttagtggatggttcatggacatcagttaaatactttatatgtatacagcttattttatctcagttattctcctgttttaaaaataaattattaaacactaataacaactgaagggagatctggttgatcatagtgattggtattagctaaacactgtcctttcagtgctatgattatatctttgttttaatagacttcattttttagagtagtttaagattcacagaaaaactgagcagaaagtacagagttctcatatactccttgcccccacatgtatacctccctcaccatcaacatcctgtaccacaatggtacatttgtcacaattagcgagcctatatgtatacattattatcactcaaagtccactgtttccattatactcttggtgctgtacattgtatggattttgacaaatgcataatgatgtgtatttgccattatcgtattatatagagtactttcattgccccaaaaatattctgtgctctgcctattcatctgtccctcaccatgaatctctggcaacctctgatctttctactgtcaccaaagttttgctttttccagaatatcatagtgttggaatcatagaatatgtagccttttcagattggcttctttcacttggtaatatgaacattcactttttaaccatagtactgtatttgatatacagctacatatgtaattattttatttcaagtctatgtttgtgagcccctggttagctgagtgtagacattctcaagagggggaaagggatgtggccttttgtgtagcatctcaggaagacactaggtgggaagaggtgatcaacccatcagtcctcagccccagggagtgatgtagtgaaaattcacagggttttacaagaagaaaaccctgtgaatggttttcctgttattggacgatggggaggagatctccccataactgcaagaaaatgtctaattgcagctatagatagaatactactcagtaataaaaaggagcaaactctcgatacatacgacagtctggatgaattttacggacattttattgagtgaaaaaagtcagtctcaaaggttacataatgtatgattccaaaatgataaaactacagagatggaggaaacataagttgttgccagggattagtgaagcggatggagggtttgaccatagtggtacagcatgacggagttcttacatggtgatggagcagcatcttgattatgatggtggttttatgaatctatacatgtaataaaattgtgaaaaactacagacatacatatgttataatgagcacatatatgaactagtaaaatatgaattaggcctgtaatccaattaattgtatcaatgtcaatttcccaattttggtcttgttccatagctatgtctgatattaccattggagaaagcttacttggaggtactcaagactctgtattatttttgcaacttccagtgagtctaaaattgttttaaaataaaaactatcatttaaaaagcaactttaagtgtacaattatctccaaatgaaaagcttaatgaaaaacatgattcatcggtgtttcagttcattataatggcagtggaaaccaggaaatgtgaaacagtttcagagattcaactagtgttagcacacatcaaatagtaatgaaacaaggcttttaaaaaatccctaacttccaatattagagcaattatctttaatcataactgaaggatgtcattcactgtgccacccaaagtaaataaggacgaaaattatgaataagaaacagtaaaaagttaatattacataatatggtagtcaaaatagaaccaatgagtgccaatataatgaacctctccc

SEQ ID NO: 10 - DNA, 167695 bp, Homo sapiens
accttcatacttcttccacacgcataccaaagaaaataagaatctcaaggttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggtcggtctttctccaccagactccacctggaactttcttccttttcgtcctgtgctggcctaacccctgctcggcctcggccctcagctgccggctctaacaaagcctctgtctttcccagacccctgtgaccaggtcaggctctgctccctgcgttcctctctccttgcttccctcctcctcccctccccagaatcgcttgaacctgggaggcagacgttgcagtgagctgagatcgcaccattgcactccagcctgggtgacaagagcgagactccatctcaaaacaaaaaacaaaaaacacaactcttgctggctccttgattttagcccagtgagattcacttctaatttctttttttctttgagacagtctgttctgtcacccaggctggagtgcagtggcgtaatcatggctcactgcagcctcaaccttcctggactcaagtgaaccttccacctcagcctcccaggtagccgggactacaggggtgcaccagcatgcctggctaatttttgcattttttgtagagatggggtttcactatgttgcccaggctggtctgaaactcctgtgccccagcagtcctcctgccttggtctcccaaagttctgagattacaggcatgagccactgcgcctgggcttccatttctgatttccaaaactctaggataataaatttacattgttttaagccaccaaattgtagtaatctgttacagcagcaataagaaatgaatacagccatgcttgataattcctttatcaaaagctacctattggtgttaggaagtattgttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgtttt

SEQ ID NO: 11 - DNA, 170129 bp, Homo sapiens
ttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgcc

SEQ ID NO: 12 - DNA, 171655 bp, Homo sapiens
atctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaat

SEQ ID NO: 13 - DNA, 173764 bp, Homo sapiens
ttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaat

(The sequence listing continues in the following parts.)

What is claimed is:

1. A method of hybridizing a nucleic acid probe comprising:
   (a) hybridizing a nucleic acid probe or probes to a polynucleic acid from a human subject by nucleic acid hybridization or microarray analysis, wherein the human subject has Autism Spectrum Disorder (ASD); and
   (b) detecting a genetic variation in the polynucleic acid by the nucleic acid hybridization or microarray analysis, wherein the genetic variation is a copy number gain of a sequence consisting of SEQ ID NO: 642, SRN420, SRN421, or a full length complement thereof, wherein the genetic variation is defined as compared to NCBI build 36/hg18.

2. A method of synthesizing a nucleic acid product comprising:
   (a) synthesizing a nucleic acid product or products from a polynucleic acid from a human subject by PCR or sequencing, wherein the human subject has Autism Spectrum Disorder (ASD); and
   (b) detecting a genetic variation in the nucleic acid product or products by the PCR or sequencing, wherein the genetic variation is a copy number gain of a sequence consisting of SEQ ID NO: 642, SRN420, SRN421, or a full length complement thereof, wherein the genetic variation is defined as compared to NCBI build 36/hg18.

3. The method of claim 1 or 2, wherein the genetic variation is the copy number gain of the sequence consisting of SEQ ID NO: 642 or a full length complement thereof in the genome of the human subject.

4. The method of claim 1 or 2, wherein the genetic variation is the copy number gain of the sequence consisting of SRN420 or a full length complement thereof in the genome of the human subject.

5. The method of claim 2, wherein the nucleic acid product synthesized from the polynucleic acid comprises cDNA.

6. The method of claim 1 or 2, wherein the polynucleic acid comprises a nucleic acid from blood, saliva, urine, serum, tears, skin, tissue, or hair from the subject.

7. The method of claim 1, wherein the detecting comprises purifying the polynucleic acid; and performing a microarray analysis of the purified polynucleic acid.

8. The method of claim 1, wherein the microarray analysis is selected from the group consisting of a Comparative Genomic Hybridization (CGH) array analysis and an SNP array analysis.

9. The method of claim 2, wherein the sequencing is a high-throughput sequencing method.

10. The method of claim 1 or 2, wherein the detecting comprises detecting a first genetic variation that is a copy number gain of a sequence consisting of SEQ ID NO: 642, SRN420, SRN421, or a full length complement thereof, wherein the first genetic variation and a second genetic variation are in a panel comprising two or more genetic variations.

11. The method of claim 10, wherein the detecting comprises detecting at least two of the two or more genetic variations in the panel.

12. The method of claim 1 or 2, wherein the whole genome or the exome of the subject is analyzed.

13. The method of claim 1 or 2, wherein the genetic variation is the copy number gain of the sequence consisting of SRN421, or a full length complement thereof in the genome of the human subject.

14. The method of claim 10, wherein the second genetic variation of the panel is selected from the group consisting of
   CNVs of SEQ ID NOs 1-641, 643 and 2418-2555; a CNV sub-region (SRN) of SRN1-SRN419 and SRN422-SRN431, and full length complements thereof.

15. The method of claim 10, wherein the two or more genetic variations of the panel comprise 10 or more genetic variations.

* * * * *